United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 35

SEQ ID NO: 437 - DNA, 960057 bp, Homo sapiens
tcacttcagaaagaaacaaggtttatttgatgaatataaataaggcgatcagcacaaagtacttctcatacacatgacaacaaatttatgaactgtacataccttgtacattgttctactagacacgaggttacaatgactggctaatacatgcccactggtagtttccagggttccttagttttatttatttatttttcatatcgatgtccataatcacatggtcaatatcacaacccacatgccactcacttgaagaaatattacaagaagcactatcaaacgagggtctcggggaattagatacactgaccctgggcagcattcaatcgccactctacacaaaaacattgcagatagagcttacgtcaacacatctgaggtctcgtcataaacactgtttaaaaagtaaattgaaacccactttcaaatgaaagttgacacgctgttaacgtgcatactggatacacaaaaatcattaaatacaaaattgagactgtacatcgaaatcaaatggggtataaagcacaagcctgcttttgcacaaagtaagaccaacttctcctaaatgttagcccaaacttcttttttcaactatgttatgattagaagaaaacctgttaaagtttgcgcaaaggaaatagcttcccaacatcacagtgtttgttgtaaacccagagactattcttaatatgtgaaaaagggatatttttggtaacccccaaacatcagagaatattacacgaaatgggaaaggttgttatgttagagagaatttaatttttaagggactaaattatacgacctcataaaggtaagatcagtaatattttaaccaatgaaagttgggcagaaaatgatccctccaaacaagagctgtgacaaaattggcacatacatagaaatagctagctatacatgggttggttttttttttctgtttcaaggaccctattttccctactggatttcctacttcctacttcaagtattcagttgcagagttcaggtcaagacctggttgtaggaggcagtgagaaccacttctttgaggacatccaaactgttcactgggacacatttgtggcctgggttttcagtgcaacattgtgtcaaaatgtgctaaataagcttgcaaagaactctgcttacttctctaaccaagacctagatccctctgatagttaaaggacaaacttttaaaacatgaatgcatttggattgtttatgcaacacataagcattacatagtttgttatacttactgatgacaagaacaaagccagaagcaagaaacctgcttgagtatcttaaccgcgaatgcaccaagaaagaatggtgcaactcagggacggtttcatcttccccgacaaataaggtgtttgtcttttaaatatctctatggctcacaagagaggtccagagttaattgcaccaacattttaaaaagtaataataatgactaaattcaatgcaagacttcagggacatctgtttagaatcctttccacagcagcaaagaaagacaactatatttattaaggccactcatgcttaaattcactgtttgtcctttaaaaatgcaggttttcatctcccacttgcatacacgtggaagggtttcttccattgacaagaaaatggagcaatacaagagttgcacatgtttgccagactcagtcatgagttttatgaagttataacaatttaaattgtttcttaatattcagaggaagcagtaggagtttaattctccttagtaccatatcactgtatgtaaaagacctcaaaatttggtctttttccctggcatgtgctttaaataatgactgtatccacatacatgttgtgtagagctatatacagagacacagcttttgtgattgttcctcattcatcaatgttttcatgtttgatgctgaaaatgctttggaatccatgttgcagacacattttctttaaaaaaaaaaaaaaagagaaatgacccttcatttacagaaaatctaagcttacactgtttgcacagcatttggatcttgaaatgtgaatgagtcccagcttcttcatggagacctgcatgcaccgggatggtaagagtctgaggcttggtggcgtccccaccgtggggatgtgcagaacacagggactagagatatgcaggtgcctcagacttttgccactctccagtacatgactgggtagataaaattatgaatgatcaatttagatgtgccacgcattgtcagagacacacaccatgttctcataaggcgatttcttggcaagcattagtggtttaaaaaattgatttcttttccaacctggcccagaggtgactactggttacaccctcaaaatgcggttcttcaaacaacagattaaagaaatagaggagggtaaaggctcgcaatttttggtgttttttgtttcttcgtcaaacactccatgcatcatggtatacaaacactgccaacaccactcactcacagcgaatttatactttttgataatctaatgcattaggaatgaccaattagagtgaaccagcaggatactggagatgaggctagttgtccaacagaagctgaatccacagataaaatcccatggagttcaaatttatccaatgatgtttaagtaacataaacaaaatgttatcaaataatgacattcagcaaagatgatcacattcaaaatgcccgcatcccaacaaaaatggaggatctgtcacttttctcctcctctgcattcttcctttccatcataaccaaatccatgagaaatgacatgaggtggtgaaggaaatatcaagtagaacagaatcacgctcaataaggtaagtgaaaactccccttcagttctgatgagccgctccaggtggtggtggacagtgatgtgagccgcactgcaatacattatcagaatattgctgcagagctgcatgttccctttattcagcccttctaatagctgcaacaagaaagcacataatttagcaggggaagaaactggcaacaatatctgagataatcctggcagaacgtttcccactcttcacccctacaacagcctctccaccactctcaatggttggggttgggtgggagtggggagggggtaaggggaagaaacacagaggaaggacaaaggaaacagaaagataaactacgtcctgcaagtgcatctgagaagaggcctctttcaaaatatgtcacgtatatgtataaatgtctcttgatatacaaaaaaggaaattgaagggaaatatgccaaaatgttccagtgattatttccacataatcggactatatgtcaacttttattctctctacgcttttctacaatgatgatgtttttaaaattattttttaacttgattttatggagattaaagaattaaaggtggttaagatatcagagaacttagcatgcacttaaaaaccaaccaaacataaatgtgacagtcatccatttgtctatttactgccctggggaacaggtatccagaagcaccccaaggtttctcactgtcccagtgaggggcccagagtgtggatacaactgcatcctgggaagcaatagtgcaatgagtgagaagggggatccctcccacactactgcttcagatgaggactttcttccctgctgatgctcaactttgtgtgcctgtgccattatcattcacatatggcctgtgagtgcttctgggtttccagccacatgagctcagctatctgggaaatatggcagggagaggaaagatcaaacatacacacacacactcgtgtacacacaagtcaccttgtatatatatcctgagctgtctcatttggtggttgatatgcagcatttttcgagtcacgccgactaacaagaatgccaaagatcccagtgtctgcacaggtagccagctatttcaagccatcgttaagtagtgcaaatgaaatatgtggcttggatgaactctgctaattcatactctgaggactttggtgtaacccttctggttaagaaacttgaatcggggcaaaaaaatgacttttgcagagccagaaagttagggagttcctagagcagatcatattactcattctggcacataaactctctgcaaactttgtatgaaaattgtaagtcagagcacgctttctgtttcatgagctgtgcatagctctaattcttttgtgcattaagcatttcttaatcatccttttaaagggctgaccaatatattaaaaggccacatgattaaaaggtaaagagaaaccctaagtagtattaaaatgcaccagtcttttgttttgttttgttttacagatgaaaaataattacagtgaatgtctgatgtccttgatgtttttccaagataaagtagcaaagaacagtcatttattcagttgtgagaaagatttccagctgggcagcaggtcacaaggcagaatacaatgccccacaattgcagcaaactgcttttgggtaaggtttatgctggagacaagagaattctcaaaaagtgtagccattctttcaatcgaacaatccattcaccaggaggcctaaatggctttaaggaaaaaaagaaaaacaacaaggaaacctcaagtgacaccgccagcatttagaaatgcagatgatcccttctgggggggcaaagaagcatatgctttaaaaataaaaataaaaaacgaatcctggcttccagcaatgagccaatctgggctgccacccactgtgagatgatccctggccagtcctccctcacctggacagtcacagcggcccttacccttctccagcttcctcttacagcacccaactctgcgctttcaacgcagcagccaacaacagcgccatttcaatggtgacatccagtccatagtgcattcccgtttacagtttacaactcctgtttacaaccctgtttataatcccgttgccctgagaatgcaggactgatggactcctggccatactggcgaggccccatctggcctctctctctgcagtcctgtacttaacgctgacattccactctttatgttccaccaaagctgagcttgcttctgcagccctaaaaatttattttctccccctctcacaagcgtgtctctctatctaacatgatttacaccagctctttatctgatcgatccctgtttattcctcagtttcagcttggatgtcatgtcttcccaagaagcctttcttgaccctctcggatgtgatatagagtgggaagtctcacatatactgcagagtccccttctgatgaattgtctagacttgtacatccaatagagcgtgtgtgcatgtatgtatatatatatatacatatcttttattttaaggcagggtcttgctgtgtcacccaggctggagtgcagtggtgtgatcatggctcacagcagcctcgacctcctggaatcaagcaatcctcctagctcagcccctcaaggagctaggactacaggcacatgccaccatgtctggctaatttttgtatttttttacagagatgtgttctcactatgttgcccaggctcgtctcaaactcttgggctcaagtgatccacctgcctcaggctcccaaagtgctgggattacaggaatgagccactaaacccagcctaccagtttagagagtacctcaggtaggcagaatccttaaatctactccttatccaagattccctatccgaatccctggcacagggagtgagaacgtttcagaccacgtttactataaagttaccttacagatgtagttactaatcagttgacttcaaattagtctaaagggagattatcaactaagcgaggtggcacatgcctgtaatcctagcactttgtgaggctgaggtgggtggatattttgagcccagaaattggagaccaacctgggcaacatggcaaaaacccgtctccacaaaaaaagttaaaaattagctgggtgtggtggatgcccctttggtaccagctatttgagaagctgaggtgggaggatcaactgaactggggaggtcgaggctgcagtaagccgtgattgtgccactccagcctgccaatccagtaagctgggattgtgccactccagccgtgattgtgccactccagacaagagtaagaccttgtctaaaataaaaaataaaattttttaaaaaagggtggatctgagtggacctaatttaatgacagacgccctttaatagcagagacttttatttgctgtagcagaagagaaagttagggaaatctgaaaccagagggattggctgtgctgtgatggagggagccaggggcaaggacctgagagcttcctataggatgtgagaatgtcacccaggtgactgtcagcaagggaacagggaccacagacctacaaccacgaggaaatgaattctgccaaaaacccgaaggagcttgaaggtggatgcttcctggagccttcagattaaagtccagctaagtccaccttgactttggctttatgagatcctaagcagagaacccagttgagcccatctggacttctgacctatgcacaaaactgtaagctaataaatgggtgctattttcaccaccatatttatggtaatttgctatgtagccaaagaagactaatgcagcaccacgctgggtcaggcagtgtgcttgatgccaggaatataatagtgagaaaaacagacaaggtccatgctttcatggagcctgtattcttgggaggaagacagaaacaaatagacacacagatcaataaatgaatgagaatgtaaacatttgcaccatgaagaaaaggaacggggaactgtgatagggatgcctaagatttattaagtgactgatgacaattatgacgtcaatctttattttcttttgataggaaaagatgtccgtccacaacttttcagtggaaaaagcagattaccattttatatgcatagcttcatctcatttttgcatcaacatgcacataaacaaacatttgcaagtgtatacattagaatattattaatatttatctctgggtggtggttttaaacttttcccctgtatttaatttttatttatttatttattttgagatggagtctctctctgttgtccaggctggagtgcagtggcgcaatctcggctcactgcaacctctgtctccctggttcaagcgattctcctgcctcagcctcccaagtagctgggactacgggcatgagccatggtgcccagccgttaaaattttctccttcagactttttttttttttgctctttttggatttttttaaacctaagaatgtataaatagtatcatactaaaatataaagctattttctttgtggggagaaaccagtattgggtgggactgctgctcttgacttggttctaggtgggggtgtgtgaggggcggggtgggtgactgagcacagcagtaagattccgccccaggacagacgccccagggagagcaggctataaacgtgtggtgtctcacaaatattccttcagactgtttttctttggaataaagacacctgcccgattatggctttcttctcctgccctttcagtagtgatttgcagaaacaggctgggagaaaggggtctttggtaaacacggaggggttaaaggggaaactgtttaataacagtagtaaaacgcaggctatttttgacatctgggttaatgtccattatgttccatgtgctttccaaatgtgtgcagtgtgcccccaggtacaaaaacagacacccattcacgacggcttcagatgcccctaacacgctgcacgtggtgcccacataaaaggcaagcccctgatagactaattaacaacggttggaggagaagagctgctccttctgggggcagcgggcatcctgcagaacagctccatgaagccactctgctcacaggaaaacccaatagagtcgtttctgctaaaaaaaaaaaaacaaacaaaaaaccaaaactataactacatctgtgttattacttaacatctttaaaaacggggtggaatgggtttcccgttttcctcatgaagatttatttattattgttgtgatcaaagtggcaacaaattatgttaaatcatttaattttcttgatagaagcaaccaccttgaaaccataattcaaaaaatatgagtggagagcaacattttaccttgagagtggactcctacagctccacggggcaataaaatgtaacacttcagaacccaaagggctgggggctgggatgggggtggggcggggccagccctgtgctcagaattgcacactgctgttagggatgacggagtttgctgggaggaggcagtggagggacttggtatttcaactttggtttctgtgcacggggtataactcatccataacgttttaaatgaagggattcaaatgaatataggctgtgtacatcaaaatggcagcacagactgctatgtctccgtaggatttatttttgtcattattattgtggtcagaattattaacaggtaccatttgttgcgtgctatctgccaccaccctctgtgttttgcattaattatctgaaaccagctcgatagcactgaggtactgatgcagttggttaatagcccctcatgcagatgaggaaacgaaagcttagaagaactggatgcttttggtaaaattccccagctccctggggcctcatttgaatccaggtcttttggactccagcgaccattctctccagagaccactgcctccttgaggcaagcatttcctaaacctgtcttttgtgtcctacttttcccatttttgtaacctctccacaatacctgtgatatgtaactaacatttttttaaaaattatctaaaaactggccgggtgcaatggctcacgcctgtaacctcagcacttcgggaggcagaggcgggcggatcacttgagtccaggagttcaagaccagcctagccaacatggtgaaaccccgtctccactaaaaatacaaaaattagccaggcgtaatggcgggcacctgtaatcccagctactagggaagctgtggcaggagaatcgcttgaaccaggaaggtggaggtggaggttgcagtgagccaagattgtgccactacactccagcctgggtgacggagtaagactccgtctcaaaaaaaaaaaaaaaaaaaaaaaattatcaaaaacctaaatgtttcctttttaaagaaatatttattttgctgccataatagaaccattatctgtctaatatgcactatgataattgcatggctattaaagtaaaagtgcttgttcacagaacacctaaaactatctcctggatatgctctccttgccttcaatcagccttgcctgcaagatggttcccagcgcccagccatggccttctccccactggcagaaccaggcacgagtcggctggtcttgcatatactctggccaccggccagccccagcaccaccctagtctacattttgggcttttgtcttctcaagggcagaaagcagtgaaataaaagatcagatatctgccatttaacacaagcattaggtactctatgcactttttaaagcattggttgagtagaaatgtatttgattgtttttcctcaaaagaataccttctttaacaggagagactgcccatggccaaaggtctttgtcactctactccaaggtttctccatcttggtactacggccatgtggggctggatgattctttgctgtgggggctgccctgtgcatggtaggatgtttagcagcatgccaagccactgcccactagatgccagcagcactgcccctctcccagtcatgcaatcaaaaatgtctcaggacatggccaaatatccctgggagataaaattgctccacttgacaaccactggcctagtcaattgttactgtacacaattggttgactgtgctgttttaagcagtgatatgttggtagatatgtacagtatatgcatacatgcatctaccaacctatataagatatgaacacttttggagaaataaagattaatttctaagctgctttcatattatttcagaaacagttgcatagattgaaaagtcctgtggaaataggtaggtacaacctcagtaataaaaataatgaaaatgtacaacttttctgacataaaaacagaaatgctacaatcctgagatagcgagacacctaagacacttgctgagttaagtgaaaaggtgaaatctagtttaaatttatagcattccttcagtgtccctctaggagtttggcattttgccaagcttccttgttaaaaatttgttaaacgtgtttggcattaatgcaaacacaaagtggtcatttgttacaaattctattggaatgcattcatttaaggcaatgaagtagttactagaaaagaaaaaaaaagttcattaagtacattttaaaaatacaatgatgtatgcagtgtgtaactgtggcgccctggtggctatataaatcgctgacagaataaccacacgttgtgtttagtttgaaattggaatcttttaaacacaaccgatagaacaaaaactggttttgtttgttgtcaaaactaatgatagtctttcttttctgaactagttaaaataaccaaaggtttggaatacaatttctaacatctcaaatcagtgtaacatacaggttaaaagaatgctttgggaatctttgcgggtgccactactgacatcagagatgggggctgatccaacaaacagaacacctgcactctggaaagagggggatgtccgagtcatcctggagaaccccacttgggtagcgccggtacctctgctctctgagctgcctgaggttattaggttacctgcagagggaaaactgtggctttcatcacagagacaatggtatcctatgaacaaatatcctaagcctgtgtctagaactcccactccctgtcctgccctaaactgttcacacaaaggaattattgctgagtaatagtgattcctgagcttgctgaagaaacagttctgaagctcagctccatgagaaaggggatacttgacatcatctgaaatgtagccctgccacatggctggctatggatgttaatgtggaatacctcatcccagggcccattgatgctggctaaaaatcattgttaaaggtgaatgaaaaaactcaccatttccaagaagtattcagaaatgatttactactttcttcttccctttctctctcacacgctgacatatttaatacttagtaccatgaaagtgtccagataatagaattccagtggtcctgagaccctgggaccagatcaaattcccatggctcccaaacttccttatattgatctcttctgccatctgggtttgatattatctaggctgcccttgaagcagatggatccaggatctcttgatcccaatctctggaaacattctcctagttaagggtaaatttaggctggacatcatggttcatgcctgtaatcccagagctttgggagactgaggtgggtggattgcttgcccaggagtttgaaaccagcctgggaaacatgacgaaaccagcctgggaaacacgacaaaacctcatctttacaagaaatacaaaaaattacccaggtgtggtggcaggtgcctgtagtcccagctacttggtaggctaaggtgggaggattgattgagcccaggaggtcaaggctgcagtgagccatgattatgccactgcaccccagcctgggtgatagagtgagacccagtctccaaaaaaaaaggaaaaaaaaggataaaattagacaaaaccttgcaccctgtatgtggcctggaaaagtttaccgtacccttcacaaatgccaaacaggctcaagaaacaaaaaggcagccaggcgcagtggcacacacctgtaatcctagcactttgggagggcaagggggacagatggcctgagagcctggccaacgtggtgaaaccctgtctctactaaaaataaaaaaattagccgggcatggtggcaggtgcctgtaatcccagctactcaggagggtgaggcatgagaattgtttgaacccaggaggccgaggttgcagtgagccgagatcgtgccactgcactccagcctgggagacagtgagactctgtctcaaaaaaaaaaaaaaaaaaatctaagaagagagaaaatacttatctccagaagcaacaagaacacatgataggaaagggagaaacacaccttgaatactgtggaacacatcttggttttgtgtggcctaaagttcgtaccattttagaggccttctttcagaaaaagaatacataaataattgactatttcaagcttgataaaaagatacggccttgtgaacatttcactggggcacctcccagggccttggaaaagtcagcttacctgaggtgctccaaacgtaagctccattatcttcatgataataagccctgttatcttatttttgagatggcattttcaaattccaatgaaaataaagtaaaacactgttaaaaagccctttactgaaaagaacttggttttaagatgagcctgccatagcatatacaagtcacaggaagacatctccctaaactggatcttaagaaagctgtcatgttcgggaaagagatgccccctcctagaaaaggagccagagagaggcattctggagaatttgaaacatgaaggaacaatttgatatctcaagtttactgaccagaagtggctccaatgacaagtgtttacaacaggatcttcatagagccaataatggcaattagtctccaggatttgaaggcgcccttcccgcctcactgaggtggaatgccatttactcttgggctggtgactaattaggggtctcgtttgaagatcaaggttttgcgattcctgcttcttaataacatggtttgcctgtcggccacctgggtccaggcgagacctccctttccctctccccacacagcaagcactgccttaggccagagcaagtgtgggcaggaaaccacagatccagccttttgagcaatttaacctcttcaccgccaagatcctacaacccagtgcttgattcagctgtgcaaaaatggaggcatttgaccttgtttctcaggcagggctgaaggcttgcctgtggtgcaaagaaaccaccttggaggtgaaatgctatgcagcatactttcttggagaagaagagagagagaaagactccacttttccaggtgagtagctcatcaagaggctgtctgcatttgcttcaggctgggccatttccagaacgcctaatagaagtgactggcaaaagaagggggtaggcagagccctgatgtaactgctcatgagaccaaagaggctgaggtgcctgcatcttcagacatcttgccaggaccccgtggccttgctatgtgaggctgggctggggctacactttctaagacatggtgggggagaagccaaaacagcaggaaaagtaagctgcaaagaattaagcttgtaacaacttgggcaaagcacaaacagtgactgaggttgctcctttggctgttgacacacgctggcctgggtcggttgtggtcactaaacccattagcgttccaatgtggcaacagctaatgcagcaagttcaatgtgtttttgtttaatttctaaatgctgggtgtatgcctgcaaggatggcctgctgaagacagacaactccactgccataaacacagtcatcattgtcagtgatctgaaattcattttttaaactatttatttcttggcagataggggctaaatggagttttgcatttcatgaactattttttaacttcaacttgctacacacttctatgtgttttctaagcaaccaccaattcagagtttccccgcaacaaaaggaaatagtcttctctggggggaggggaccatttttggtaggggagaagggaaaagggaaacataaacacaaaccagcaaccagctgggtgaagtcaggccttttaacgatatgctgcctctctgggccctaatcctcacctgcaaacaaaggaacaggaagaatgctacctcgttttggtctgcagagttgaaagtgaagtgggttcttaaatgagatacaaaggcagattcagtctggattttatattgtcttcaatctttgtttatgaaaactacaggaatccttccttcctttctcctttccttcccaccctcccttgcccaacagaccaccttaaagggaaacaataacattcccctccaaagaatgaggagtttgagaaaagcaagcagaggttatttcagtgggaatctgaggccagtcacatttgcacagtgccaaaaagcagacatactctctggtttgaacttatatttaaatcccatgccaaagcctgcccttgtaggtctgcatgaagcacaagggcccagggctgaaacccttggtctcccatctccagctcccactcagggatataagtgaactctgtaaatgtctccacgtgtaactgggagagctgtaacaatgggcctccaagatgggcccattctcccatctgttatggggcttccagctatcatacatgtttccaacttagatgtagacgtaccctgagagggaatttctgtgctgcttttgtccctggtcactttgaagattaaagagaggaaaatgtgttttcataatatgtgaactggctggaagtttccctattaaatcccaaagtcctggcaggcagggttcaggcttaactcctctaagactgggttggcatccaggactgaaggctaggaaatgcctttgggcagacctgggccagagaccaagggactggggcatgacaaagtggtcacctgaggcataatgccagtgggttccgggggcacccttgaagccactgccaaagcccaatgcagcaggactgcagagtcccctggaagacccatggatataccagtggcctcagctttgctacggagaacttgcttgggagctagtcccttgagtgatattgcaaaactctacagagatgtatgaaattcctgatccggggtgccaatccatgaacagagattcctactgctggaggaggcacatggctgggtcttccttcagagcttttgcataggtgttccctctcacttgggcactttccccatcatcctttatctggctaccttctgcttatccttggatgtcagcttcaataccacttcttcaggggagccttcctgacttcccttcctggtccaatcctcttgccaaacaccgtcttgacaatttctcccccctctccccatatgcactcctgcttctgggcaacttggcatcagacatttgtgttaggatctgattaatgcctgactgcatcctaggctgcgttcatgaggacaggctatgtgtgtcttgctcactgaagtgtttcttgtgttcctgccacacagtgggcatgcaataaatattgaagtaggtgaagaagagagctaactaagttcattgatggtaacacacatttatcaaatgctgactgtgtgccaggaatagccccaaatgcttctgcagcagtgattttcaacctcagcactactgacattttggactagataatttgttgctgccataagcactaaaagtgagagccggagacagggcctaacaggagcttcgtatgtgtagactacctattactccttcccctttccattttgctgacttcaggtaagtcacttaacctctctgagcctcagttttctcatctccaaagtgaagatagtaactctaacctctccaggtggttgagaacataaaacaaaatgaactctgcctataaagtcccttactaatggctggcatataacaggagtgcaatgagaagtagtccttattatctccccctctatactcgcccatacagcagagagctgggcaataggaccagcttgatcctgagtgcagaaataaccacagtggggtgttcatgcccaggttatgtatgggcttggtcatcttcatgaaaagatgtgtgcacagtaaagagagaacacatcactggggccaggaaggaacagtggtagaaggaaccccaagcttccccaaaactgcaaattccctgcctccaacctggggcacctctggcagccagccacgttggcagcctcgtactttctcttgggctcttcctgttggcatagcccaccctgttttacaaagctccagtggttttttttttttttttttttcatggctccagctgttagataaactttcaaggatatttctgtggcaggtacaaacctggacaggaagacttgggaagaaatcctaaattaattatatgtcaacatttaagccacaagaaggagcagttgtcataaatttttggaaggttaaaatccaattttagttgtaaatgtgagcaagctcactgactcacttgtgaacgggtgccaacaaaatgatatattttacattctttcacagcttgttttggctaaacacaatgaaaaaagagagagagagaggaattacagtttttattcttcagtgggctgaggtgttcaatcatgcacaaaagctacatgtgccaaagcagaagaaattagctgagtttatccatatttttgggtgccttccacctttatagagaaaggaaatggagctgaaaactcaaaagacggccacaggtaccgcagttggtcatcgttagtgctgatggcccaaggctggacattcctgatgacaaatcaagactcctccaggaactaccctcatggtttatcctcagtcctgaccaaaccctggcacactaacaatttctaaagcatcatttctctgagtattggcttgggttgaatgcaatggtagggtgtcaagagcaggaaggcagaagaatttcctttaattttcacaaaattaggaaggtggctgggatacagttataatttttgcctattttctcattcattcatgcattcattcagttcttcaattcaacaagcaatcatttttgccagccatgggccaggactggggatttgagggggagtaggacataaaccctaatctgggagacttgcagccaggtcaggggcacagatgggtaagaagacaactgaaatacaatgtgatgtgtgagttcatgggggcccaggatgccccgagacacctcatatggtgtcagagagggccagcaaacattcctcatagaagatgacttccaggttgagatgtgaggggtggtgagtaggagctaccgagtggaagagggaagagaggaaccatctgagcagaaagcagcatgtggtaaggcctgaaatagagccaggccaaagctgacccagtgaacctcaagcaccaaggacacaacatggaatgggaaggggggagtagcagagtcagggcagagatgcaagcaaggccaggccacgtgggactttatggctacattaaggagactagatgctgccttcaggcagtgggacaccatggaaggggagtgacctggccagatgtgtgacttcagggcaaagtggaagctgggtggaggcaggtggggactacataacctttccttaagggaagaacaattccttgggtggtgtcagttgaactctgtcccctaaaaagatattttcaagtcctaaccgctagtaaatgtgaatgtgaccttgtttggaaatagggtctttgcagatatatttgaattaagataaggttatactgaattaggataggccttaatccaatgactggtgttcttagaagaggaaaaattggacacagagacacagaatacatacagggagaaggccatggggtgatggaagcagagggtggagcaatgcatctataaaccaaggaatgccaagggtaccagcaaccaccagaagctcggaagaggcaaggaagggtctcccctagaggcttcgaagagggaatggccctgccagcaccttgattttggacttctggcctccagaaccatgaaagaataaatttctgttgttttaagccaaccagtttgtggtactttgttacagaacccctaggaaactaatacaggagtcatggtggagttctgctgcactgctcccaataaaactgaaactccaggcagccttggtgctgaaaccatgggggtccatttgggagagggtcatctgagatccaagaagcatctcctcttgcttctgtctccctttgacctggttgagcaacttgtgctcaaaggcccgcgtcgtggctctcccaagggtggctgtccgtgagagagttagcaccaaaagtcaatatttgtccacaggcaacagttgtgtttgcactatgaaagccccaacaggttttttcagagatttcaattggccatgaagtaactctgtcccaaggaaacccctgaagatgagccaggagggacaaaagtcccaaacagtaggctctggcaggcagcatcacaggaagcacgaggggactcgtccccgggccagggtcttcacggggccttggtgcacaatcgctgtgcttgtgctgctgctggggttggacttcctcatgcagctcagccaaagcctcctggccctcccttggtgctgatcagctgttcccagctggaagcagcaatgtcatcctcttcccaggactccagctgacacagctgatgggtctgcaggccagcaggagcacacgtgtctccacacctcctttgggaggaagggatgtcctggccaccccagttctggcctggatgggggcaggagagtcaggaagtatccacatggctattcagtgcctagcacagtgcctggcactaggaggttcttaataaatgaatcagtgaatgaatgaagaccttgggctctttaatccaactgaatttgagtccaatcgtggcttagcccatgattagctatgcaaccttgaacaagaaactgcacttttctgggcctccactgccccatctgtcagacggagatagtaaaaatatctaaagcatagaggtgttgagagaaatagcatagaccagacatgttagtgcttagtggggggcctcacagtcttaagggctcaataaatattagtcaatatgactatcatttttattgtggagttgtatgccagtgtaaaagaagtgttcatatttgccagctctagacttgggggaaaaggatgagagaagagaacgtagcgaaatcctcttaagactccagttcacaaaccctttgctattaccttgatctcaactgaccgtcatgacaactctgtgacatagggcaagggttgtcatctccacttctgataagagaatctgaagttcagggcaattaagtaacttaggcaaacacttttcagtgataagtagcagagcaaaaccccaacccagaagtcttcccatgacatcacaacaaagtacagaggcatgccatacctcctcctggaatgaatgaatgaatgagaaactcaatcgcaaaatgattctcaggtataggtgggaaagaaaataagagctaaaaactataggatggaagcatcagagacttgggcactatttcatgcgtgggtttgggcagtcaactccccttttctgatctctgtctctcaatctcttctagttctcaaatcctaggaggaggcaatagggtagagtcagggtagagtcagaggccactcctcagctgtgatttaatgtcctgagcctcagtttccttacctgtccaataaagatagtaacaccccacaggcttccttggaggatcaggggtaatatgtacatgaaagggcttcataagcagcactgatattaaaaaggatgaagcaaaatatgatggcagattggaaaaaagaacctgaaggaaatggcccaagataaaaatgcattaatattaaccaacaggttcctttagaacaacaaagcaatgaaacaataattttagagaaacaaaaccctgcctaggaacagcctgccagagggagcggaaatgaaggcacaaccaagtggcccttggcttacctatctggaaaataacaagatgaaaaagattctttgtaaactaatatttgtaaaagccccactgggctttctgcctgcacagactgcctattatcttggcaaaggatgaaaacaagtgaattcttatttaaaatgagtatgaagcaaattcaggtaaatgttatcggcatcatcatgagctgccattcgctgaatacctactatgtgctgggcactgagccagggactgtgcatagatactttatttgacaaaaaaaaaaattttagcactctcacaaggcaggcataatattcaatcattcatatattcataaatgttcatgtttctttgttcaacagatatttcttgagcatccattgtgtgcaggtatggtactgtctggtacagacacaaggataaacaaggtctagtccttttctgtaagacaagtcatttctgacttgttgagattattctttatttaagaattccttgtggggtctgctctatgaattacaggatgtttagcaacatccctggcctccacccactcagatgccagtagtaccctagtttgataacgaaaaatgtctccagaccttgccaaatgtccctgggggtggggagggatatggggatggggttgctcccggttgagaactgctgacttagatcttaatttccacatcttttaagatgaagacagtggatctcagagaggctaaatccaaggttgcaatcaagtatgggattctgccatatgaagcagaaaccagagctgacctttgaagttgatagggttttgtttctgcatgttgagttccaggagatgggagtccccaggccatagccctgggattctgtctcatttactatcaatgcatatccacccttcaagtctacctttggattctttttttctctccaaatctgccaaatcttaaccatcataaacatttaattattgaaagttgaaggaaactctagctaatccacattctgaacccaagacatccctgcatattgctatgaatgtgagtcaattttccagtgagctcctggattgactatggagcacagttcacgttttgactccttaaacagtaagtcagtgagggtgtacggaaactcttagaggaaagagaactgggattattacattcccaaaatatcttggaatttttaaacttcaaagttgtattgcagttccaagagtagcctaacctttacaaaggttactttgcaaatatatgcaagataaagaattccctggaagaatgtccaccaggatcctaagcctacatttatatttaatttataatcaccctgaaaaaaatgggttcctctttcaaggagctcgcattacccttggactgacattgtgcaaaggagtgacaggtgcaatttacgtgaataatcaccataatcagccacacttaagaacaaaccagagacgtgctcttcagggggagaaactgctgcatcacacagtcaactactgctccctcaaatggtgcccaggccactggctgctattgacaatcaaatgcagaagacacaggagaagtaatatggctgactactgtgattcaagtactctggcctgggagacctgagttctagtcccaatattgccaaactcattgtatggtctggaagactttttcttcactgggcctcagtttccccattttcaagattaggtcattggtctagatggaataaaggctcctctttattctcttcctaaagcaagaggaataaaggattcctctttggagatgatgtcactggtagcagtaatatctcacagtaggcatttcatgaatgaatgaatcaacaaatgagtggagttttcctgcaactgcaatgctgagctgcctctgccatcttatttaattcaaaaccaaggataccttattctggggaataaatgatgtttaggtttatgaaaaccatgctatggaccagggattggtaagatagcaaagggccagacagtaaatgtgctaggctttgcaggtcttatgatcctgtcacagctactcaattctgcaatcgtggcaggaaagcagtcacagacaataagtacatgaatgggtgtggctgtgatccagtaaaacaaaaacaggaggcaggctggatttggctgtgggctgcagtcggctggctcctggtatggcttgaaacgtctgacctgacatgttctctccatcttgatcagtccctggtgctcagggcctggagagcagcacagcagcttcccaagatatctgcaataattatagccccatctctccctcagctcatctcctatggttggagcctacaaaaatctccctgcgagaacctccttttcagctcaggaacaagtatctccaagattattggcatcaaaagccatactttctccatgcgttaggctggggcctcaagagctgggaaatcagaaggaagaaatggttggaaatagagcacctgtgcacaggaacttggcccaccactgtcacttgctcatcactgggaaatcaaatccaagtgttaagtgttacgaagcctaattattacaagcagcagtcagaggtgggggtgggcatcccccctccaccagaacacctttccatctcacacaggagcacggtttggattctaacaggactatgaaggaataatttgatcgggaggtcatcgcacagggctccagagcccaactgaccttttgaagtctgctcagggaacctcattatgttgcattttggagtcgatcccttctctgatttttttccaagtctttttgccctttcattcctttgatggttagatttttgcttgatagagaggcacaggctgaggggagggagagccatggaaggaaccaggaggaaagacttgattattaagtgaatgatccactctaggggccttggcctgctactccttgggcttgacttgctggctaggatgtctttaaggagctgtaattctccagaaggcaagactcccattggttaccaacacaatttggaatgaattgatgcaaccctcaagtcacaagcaggagcccttgccaaagcaagcacagtttcccttcttgtaaagcagtaattgggagtaacttctaggaaaaggaagctgatccttccccatgacaagccacccctcccttgcccctgaacattaatgtgtttgctcagcccactgtctgcccctgatgtgcatttgtgtccttgctgccatttttcatgctaatgactcctgacttcctgctagcagaatgtcagagcacagagaagtccccaaagattcctggttcccttttaaaagatgatgaaaggtgacctggtgtataaccacatgcacaaatcacagatactcacgatctcatcaggaaaggaggtcattctccctctgatttcaacctgctgatgggaaccctcagccaggcccaggatttcagctcagcgatagaaatgaattccccttcctggctgcctttgtcgaatggtttgcctttccctgggccaccactggcaatgacaggacataatcctcctcttctctccttcccacctcaacatatttgaagagttttaaggcacatagcaaacctggtgaaggggctcatctcacttgcttgaatgaaagccttggcagtttcgcagtcattaatcatggctgtaaaaagactggcaaataaaactcaaggaactgtcctcggcttcagccttccatgctgatattccagattcaaggctgctttataccaagactacgcaaatagagctacacaagatctttggcttgagctacatcacccttttcataggatttctggatctccttggtggcataaagatatcaagggccatttcaaagtaactctgactaggagaattccctgcatgaatgggaagaccatagagctgacttctagttcaggctagacctgcatccttgtcccagctttaacatgaacacagagggtgacctgggttgagctgctcaacgtttcactgccttgatcagagctccccagctatataggtctcttcctctgaatctaaggaccgacacaatatgattgctttcattttatgattacaaacaacaccagcaacagggactaagctggggcttgtcatggggtacaaaactcagtgagattcatccctgccctcaaacaaacaagcaaacaaacctctatgtccagtgatatctcaagtatgtaataatgatgacgatactttttgagcatgaaccaggtgtcaagtacagtttctaaggctgtttacatatattaacgcactcaattctccccaagtcccttttcaatacatactctttttattctcatttagagatgagaacacagaggactgaacaggtcaggaccattgttcagggccacaaagttattaagtggtacagccaggaccaaacccagcctggccactgggccctagtaagctgcacccccatctcatggacataaaggtactatcaggctccttctttacttgtgctgtgttctcagttaatcggttcacttttacatttattccaaaatattttaataaactcttggtagagcctgacccaaggctgggtgctgggatgatagcagcaactgagaaagacaaggtccctggctctcacagggctttcaacggaacaggaaaaaaacaaacaaacaaaaactgcctgaaacccttcttctctggtgagggcccttggcccctaaaatcctggggcatgagtcagaaaatgtcttcctagctgtcaggactggctaacctgcaaagacagggtcaacactggaaggaccacagggtaaggcctcattttaccaaaatatgcttctcgcctaagggattttcacagggttagcaaatcctgtgtccgtcaggggacagagtgagatctggcaggagtgtcacagatgggagaggccaggctgtggcagaggcctcctggcaacagaggctgagtccaagaagggctcagggtgcttgggtgagagacggggcagagggagaagaacatgactaaccattctaaccagggctcatgaccgttcaaaggttccctcatctccctctgtgtccggaatgatactgacagtattcacacgaatcaccttaggaaccaacgtttgctgcatgccctgtaccaggcttgacactaagcacacagcatgtcttttggcatttaatccacactacctccctgtaaggggagtgatcatagttccatccaaaccccgagtccactccctcaggcaaaaggagcaaagaagccaaagagtagaagactgccaagaagagaggaggtgagaaaggaaggtgatggggtgagggcagtgggtaggagacccagaggcggctcaggccactggggctggtgtggagagatcaggatgccagcaaaccaaacagcaacacacgtgtgctgctcctggggagatgcttccatgggagtctcagacccgctccttgctctcctgactctcacatgcccgcacttcacccaggacagctctgcattttctcccttccagatgctgaggttccttataacatttccttcgaattcaagatttcatattattttgatgatgcagagacagtgaagcccagcgaggggcaggtcacccagggagtgagtggtagcgtggcgagctggataagaatgcagcccctacaattggacaggtcaggatggaatcccagcttggccacttactggtcatgtgccttgggcaagcgacatcctctccgaaagcccagcttcatcctcaggaaaaggataacaggaactccacactggatggatgtgaagatgtgatgagatcctgtactgaagaacttagcacagtggggtgcagtggctcatggccataatgccagcactttggaaggccaaggtaggaggattgcttgagtccagcagttcaagaccagcctgagcaacataacaagacctcatcttaacaaaaagaataaaaataaattagccttagccaggcgtggtggcatatggctgtggtcccaggtacttgggaggctgagatgggaggactgctgcaatcataccaacgtactccaacctggatgacagagtgagaccctgtcaaaaaaaaaaaaaaaaggccaggcttggtggctcccgcctgtaatcccagcactttaggaggccaagatgggtggatcacttgagcccaggagtctcagaacagcctgggcaacatgacgaaagcctgcctctacaaaaaaattacaaaaattaacagcatgtagtagcacacgcctgtagtcccacctacttgggaggctgaggtgggaggatcaatcgagcctgggaagtcgaggctgcagtgagctgagattacgtcactgcactccagcctgggcaacagacctcgtgtcaaaaaaagagaaggacctagtacaggacctggtgcaaaataatagctcaataaatagtagtgagtattattttcagtcctattcaaattcttcccttttcttggggtcaagctgcaatctgaaggagcacaaggtgatgacaggaggttccccagtcatttcaaaaccaggacccaaacagaacagtgatggcccccatggttttgagaggaaatggctgagcatcatggtcaatggaagacataacggtgaagaggcagcatctgcacaaagaatccagtggctgaagtctagcagctgaaacagccagggacacaagtcactcgaccatcaaccatcagtcactgtggccatttccaccagggttcctgctgtggccatgactcatcccaggtgtatccaggatgtagtatttcatggtgtgtgagttcagtatgttatttcagtggctcagagcttcatttcccaaccagctttccaagtggggctgaaacatgttccccttcatcttgcctgacttgtagtttcttcagctcctcttctaagtgacaggagaaatatcctctggaatattggaaagcaggaaactactgtacaaaaataaatgggtaccttaagccaacttgctggaattccactgcatgactgccttccaaattcaactaaggcccagagcttgtgtgagtgccagcaggtccaggaatattatttttagagagaaaggctgtgggtgggttttggggagagaaggtggaagtctattctaagccacaattgaggggtgttgccagagcaaaagatttatacccaggagacaaatgtttggagaaactgaggttctgatgactggtgtgagccaccggcagcagataacagtggaaaaggtgggagtaaaatagaggtaaggctcacacccatgaatggggctgtctgtaccctcttcctaaagcatgacctgtgaaaggggctaggaccatctcccccatcctatgtggaccttcttccattccttatattaaaacaacacaggctgggcgtggtcgcctattatcccagcactttgggaggccaaggtgggcggatcacctgaagtcaggagtttaagaccagcctggccaacatggcgaaattctgtctctactaaaaatacaaaaattagccggacatggtggcgggtgcctgtaatcccagctactcaggaggctgagacagggagggagaattgcttgaacctgggaggcggaggttgcagtgagccgagatcacaccactgcactccagcctgggcaacgagagcaaaactccatctcaaaaacaaaacaacaacaacaacaaaaaaacaatagttttaagtctcaaattctaatcccattgtctctgatgtgcccagagtaaactttctaaaacatacaaattggcataagtccctttggtagctccttactgttctaaggaaatacccacaagaccaagtcacctccttaagcttcttccatcttcccagctgcctccactctctgatttagctttctcctgtcctccttcactggacaaactcaaactcactgtccagacctcaggttagacaacactgcctctgggaagccctccctgagccctggtctgagttagatgattgttgcccttgcttccaaggccccgtacctccccaaccctgagacttcccagacgtagctgtgcggtcctcccagctgggctgtgagctccatggagacagggatcctgcctactcggtctgccactgtggccctagcactgtgcctgatacagagtatgtgcccaataagcacatattgtattgattggctgagctgacttgatgcagggcctggagtaaggtcttgcaggacccaagtttgttagtctctgtcaaaggagttgaagtcataaattgagaaattgtgaaacataaaaattgaaacttatttaaagagtttcgtagtaataaatctgaacttcctggcccctgctaaggggctacactaaacaaacgggtgtgggaaataactgaagggtaggagcccctaccatcttactcagatatcaagacaacctaccagaagtggggcaaaccctagatcactctcagaatgctgatggcctcccagccccctcggcccagtgcctcaaccccgtcctacaggaagggactgtgaaacctcaagcttttgccttgaaattagaggcatctaaacctgtcacctaagaactttcgccacatataattattgacctgagacatcagtcacattaaaaaattcaatgctgacagagggcaaaagaaaagcgtctagaatatcaaaaggtaaagggtccagattaaaaagagagatgcaaggagggcttttcccaagtcacagcctttaattgactccagtctctgctgaacaccttggcgtcctttgccagcatgctgggaggccgcatgggctccaccgacaccggtaactcactgcagaccagcggggctggccggccacatttccacaagaagtctcccctcacagccatgctgggtgccacaagcaatcaatgtctgcaaatgacaagtttgctgaaagaacagtcttagaaaccaggataggtttggagcatagaggtggaagacgatggtttccccccctgaagtgacagactccagaaaagcatctagaatatcaaagggtgagataccaggcctgagacttaacgaagtctggtccaaagggaggctggctggtgtttttcattcaaaggtcagttgagtaaatgttatagtcagctagctgatttctttggatcctagcttacccatctgtgaagtgattctagaaaaatgatcggtgtctctgctccccgactcgcactttagagcagaggcatacttttaaattaaaaagctctccccgcttacaaaggctgcatactctgggtcaacctctagtttagtacaaatgcagctttccactctttcagatacaaagaaatcataagctgtcttggaaggaaattaaaaagacaaaccagggtaattcttgtagagagccttagaaaccaaagtcctgcttactctgcatggaggacacaggtcatgaggacacatttcaacatctttcccttttgaaaaaagtttcattagcatcttagttttctgcaaagaagtccaaaaatggaccaaagggcttctgaaccacaaatgaaggctgtgcctattactctattagaacactgcatccccttcccccaattgcggacgagcccaccaccctccaattgtctctctggtaggtgtgtgggaggcggtggggaggagattgtatgatcagcatgtcaaatcctttgaggtcatttaggataaaactggtatcaaaaggaatgtcaagcagagaaatctaaataattaaaatctgttagtagctatagaccatcatctcttcctgtttggggtttttgtccctggccttttctttttatctgaatttcacatcaacccgtgagattttgctgggcaaaaccagctttcctccagttgctgggctgtgcttattaaatgtggatgaatgtcaatgtcacccatctcattaataattgatttccagccctgtctctatttgcagagcagaagccacttacagagtctattattccaactctgtgtgtgggtcacagggccaaaggggttccaccaggggtaacctttgttggcagcaatcaccatgacaacaccacacatctccagcctcaactcggatgccgagaaggtgctgagtcctgtcccacactggggactgggttggagtttgctgcgctaaatggctgtgtgagcaaagctgctggcaaaatgggatttttccattttaatttttagtctttgttgaacggcattgcgtgctttaacgaacgcttttggaaaccaccatggaaaagggcatttttggattcacaaaacaaaaccctgtttttctttctgtctcctcaggcaaaaaataaagacaaggtaaatccctctctggctgcttttaggtcattttaagtcaatgaaacctatataatcccggaataaccgattgtttcttttccacccgaccaaagactgcaagcttagatgggaagaattactgttttgcttttaaccgcctattaatattttgtcctaccagccacgcttcctctatccctctatcccttctttgaagatttccccccattaaattaatgtttaacaattaaatgaagccaacggagagttttgaaagatccacacaattgtggattgggtgggcgtacagagcctttaatttaagtgggaaatgtttcccaaattatggcctgagacctcacagctaattacataattttctgcatctgaaaaaacataagctgagaaaatacaaacagaatcacactgataataagagagaaaaacctggaagtgggtccattcattattttagaaaacagagctactaggcatgaaagaagcacaatgttagagtatattaacgaagggtgcataaaagcccaatgctggaacttcgcatggcttcagagatcatctgccccatgttcatcaggttgaggctggacactgaattgaacaaatccacttggtcaaatacatctgagaaatagcatatattttatccatgcttggagattttctaagacgtattttcttttcttttattttcttttttctttctctctctctctctttttttctttctttttttttttttttttttttttttttgatggagtcttgctctgtcgcccagactggagtgcagtggtgcgatctcagctcactgcacgctgcacctcccaggttcacaccattctcctgcctcagcctcccgagtagttgggactacagacgcctgccaccataccaggctgatttgtttttttgtaattttagtagagacagggtttcaccatgttagccaggatggtcttgatctcctgacctcgtgatctgcctgcctcggcctcccaaagtgctgggattacaggcgtgagccactgcgccccaccctaagacacattttcacactgaaagctctaagtcctgcaataaaaacaatatatttaatgttgtttagcccagaattggccaaatgtttgtgattatagattttttaaaagaatacttatttcagtaatgtttattaaaataataaaaatattttaaatgctcattgtaaataatactaatttaatatatcctgtggggattttttttttttttttgtaaactttttacagttctatggaaccagtgtttatcagaatatatttgggaaatgccaactggatcccatgccttataaacaaagatactgaggcctagagaggaaaggatttgttcaggatcccaagggcatcttagggagttcttgggagataaggatcctggatcgctgcatttccaggctaatgcctgtggattaaacctcatttatgccctacctgaggttatatcctacctgacaatacagactagatgctctttaagatcaggataagtcaatgtgccattctgtgacatctttaaaagactgtgatttttaagggagaaaacagaatgcacttggggaactggggagcaagttcatcagaataggtgcccactgagaattcacatagatcatttcacaccttactcttctactttgggcaacaacttgttgtggtgagaatgttccagactgagaactaggggactaagccagtattatttaaggctgatcttttctgcaaagtatggatgctgagatggctagggaatagaggtaagaaatggtctatgctcatttgggagaagaaaatccaagatttaatgaaagctcagccactgagttgctctctgagctcaggatggtgccttcttgtccgggatcttagtctccccatctgtaaaacgaaggaggtgaaccagagtattttggaggcccctcccagctttaacgttctttatcccactctcctgggagtgacactcaaagccacattcacacaatgactgtaccatgaatagctgcttttaaagtcaaaattctcttatctgggaaagaaatgtctttgttcctttcaagagcaaggtcagttcggaccggcaccccacagaccaaatgcttatgcaaagcttatgccatttctgggaggcacctagggcagtcctggaagggttggctgttccttacttcccagtcactgcaagaccctcagataacagcttctcttattatagtctggctcccactccctatgaagaaagtgagaggtgcagatgtgcaggagccaacaagtatatatataaacatcaaagttttctttggaagggaatttcagaaactcaagaaaagtcagatccaaactttgggttcagctcaggtcttcctccttaacaaaagccccattcctgaaatgctatctgagaaaaaacaatttcattcaggacatcaagccgtgaagtcatcaagtcttgaaaaacatcaacctcccagaccaccatctgttatgcaagctacatgcaatgtacaaggttgctaatttttttggccagaacttcaaattccatgcttttaaaaattaagatgacaaacaacttggttttacaaagacgctgaaacagccaaaaacagtctggctcccccttaggtcccagaaaagccacagctttgatgaaaggccttaggttgtcaaatcacgccattggtgctcgctggggtttagaccccgtagcctacatgacaagagccctggtggtagggttgactttccattgtaaataaaagccattggctttccattgcaaataaatgctaggaatggtcattcccattcttggctcttatctggcttgtgcatctgactatctctgactatctctggtagggaaagttcatgggaaggtttaacaattcatcaagagcagctttcacaatctttatgttgtcttctccaacataaaaattggccattcctaagcacatactatacacagaatccaaaaattgtgaggctaagtgtctacacaaaatggattgtctagaaagccaggcgaggactgtcatgagactccagatagtaatccaagcaggaatgttttgccctggttagttttacaaacgttgaatatagacaggtcaatgtgttaatatgccaagtcaatgttttttgaaccaattcagccaaaaacatattaaggcaagttgctagacttgaaagagtcttaagaattttcacaatttttgccaaactaccccttattgagcattttccaagcgctgtgaaaagcaatgacatatagcatctttaatcttcatagtaattctgcagagttgacgttttaaacccattttactgttgagaaaattgagacagaaaatctaagaatctatctaagatcgcaggatttatataggatgaagccaggaaccaaccaaatgtacacagataagttcttttccctatatcctacagaagaggtcagttctttttcttttcagtacagctatggtggaggtcaccactcccttgtgccacgttaatcccccaatgctgagatcattgaagattgtatcaaaaatgggaacattgcccaagatggtaaatacatctcatctagaatgttattaagacaggcttgccatggctgcctggagaaccatactcactgtggctctgtgaaaagagtgcagaaggtattggttaagccagccttgggactggagagtagtggcacctgtattacagatttctgactctgaactatggatattaatactgtcaggaccaaaactcatctctctctctctttctcatgccttgaaaaagcaacacgttgagtccgtaactcatggcaccaaacttgacttcccccaaaacttactctggcagtgaaatatctgagaacagaaaaaaggaatatgaaaagatgggacagatctttcatgaaaaaatgaagagctttgagtgtctttcagattatttcccctttctccccttctcattgacagcagctctgggtaacctttttcatccaaatttttgtctacttcaaggttacccatagcttccctaacagcagactagttacctcttgactaaaagacaaaaggaatagtcaaaacttctctaagccttctaatggattccatagtggccaatacttgtcttccttctgctttctatttccacccagaaaggttcaggtcttcctaaaacaaccactctcagcttctaccccttagagaagggaatcctctgcagggattcctcctgggctgttaccactgggatgatctgctaggtcccacatctgctcaaagcctccatatctctggtgtttcactgcaagtccatgagtctcccttctcctggcctgccttcctgccttcctgcacccgctgtgtttaatctgtccttccatctatccctgaactccatcagacctcgtctctgggggagtggaggagtaaggctgaaataacaggggctgtggaggagctgtctcggatgggggcagcagcaaaaggctgtccacgtgtaagcagtcaaatatctgcacttggagggagagctacagggagacagggttacatcagccagtaacatcgagggccagagcttagactaataggaagaaataaagaatggaaatgtttcggccggacatcaagaaaaacatcccgatgaaaaaggaaggctcccacgtgggggatgttctcataaagatgagtgagtggccaggtcactgcagcgctctccccagcctggctccagtgcggtcacaaacgaggcctagtggcctcaggcgggttagcggttggcctccctccagtttcccttcccttggagaagaccacagagatggttcatgcagatgacatggtgtgtggtcaccttcaccctgtaagtctctcttagttgtaagaatgaaggaggcacttaagctaaatcaagagaacgggagcttggctggggacggattcacccagtccataggatctggaggagggtcaggagctggggcagcatggatctcctcgttcctgctgcgctgtctctgtgtgccatttgcttctctctacgtccctcttctctggttcctcggaactacagcttgcatgtcatggctgccctggccactctcccactctctctcgaagccttacctctcaccactaatcaactccacctccccacgatcctcaattcagattctcaagaacaagaacctgcctggcctatttcatccgttcagggaggccgattcacaggagtccatccagatgatgaggtggctgctgttggtcccagtgctcagccctcatccaatcaaccatggctggggcagggcagcatgggactaagcaaggctgcccaggcaggagaggctaccgatggggatgagagtgatgtgggcctttagatacctctgggcctgtctgggacgctccctattcccctcttcaagcacctaagtctaggcctccaagcttcaggtctcagcctcccaattagagttatactcctccttgagctccagggccctgctgcttgggttgggcaagtgttcgacagacagaaaagggctgtcctcccactcacacatgtggcccagtgatgggctactgggtttattaggcctcaacgacagcattttattagtgactgatgtgccatttggcctccattccttacctcccacccccagctctatcacatccaccctttgtctctggctggaaagaggccaaatccttctccacctaagaagttctccacctcccccaccccatatcagtgggggaggatgacggggcagtccttctaggaattgtcccctggggcattatttggtttcctctcacttaccagagtcacttaggataaatctgaattctgagttgtttgccaaatgctggatcctcgctggatactccttggattccttgaagaattcagcataatataaaacagcttaaagtcaagaagccccttctgagacccttaccaagggaggcaggaggagggacaaaatacaacaatcactatcattccacacaaccatatacaaatcatcatagcaatggatgctgcctgttacgtgcctgactccgtgctagggctgttacctcatcatatcctcaaacaacaaaggaagaattacatctcacaaagtgtaaattctttgccaaagggtcctgtgaccaatgtcagacaagagatttgacatccatatctttgctaaaggtgtctacttctgtggttatcattgtgacgtttccttcatgtaatgcaaaatagcccctactttccacatctactgaactgcaccttcatctgtattgtcagtcatcattttcctggctgtataagtgctttctccaaaagacttctctcccatctcatcaatcaccaaaccctgatgcttttattctttagaatatctctggaaaccagtgcccattctccatcctcactccaccacggccacatctctcttctagattcttgccatagtttgctaatagaactccctgcgtcaacatcctccagcccatccatactccaaactccaaatggcaaccagagagctccttctaagacgcaaatccaattacatgactccactggggagggatcagaaggatggagtggtaagaagcagtgagccaccaggacacgcagtgaacactgatgtcctactgcatttctgcagagcggcggaaggtgtgggctgctgtgcgtcggatcacgtgggaatgcatgggatcaggtagaatggatgggtcacaggagtgccaggcattgtaaatggggaagagttgaacatctcagtaactgaggaacaatttatcctttcagtgggactcttaggggtaatctgcttccattggagacactccaagaagcactcacagaaaacctctgccctccagtcaggagtttctgtgtgtgtcatatggagcagacagagtacaccaacactgcaaagaacaggacaggaggagacttaaaagaggcaaagagaggatggccagctgtgctcatagttgctgtgccagggggtacccactgggccgggtcctcctgccagggttgtgagttcttgggtgtggttcagagcatggctgggctggacagccggcagcctctgctgctaaaggaacccaaggggcgggggaactagagaatcccatttggaggtcttgggtcccgttaccctgtttttggtgccttccttagggtccctgagcgcatacagggttactcagtaatgctgtgagaagagaatacatggacggaaaggagagcagaaagtgaggacccagtggtcaggagccagagagcatcatcctgacctatgcagtatgggataagctaggaaaagcttcagactggggaggagggtccagacatctggctctgtggttaatacaatgaaaagaagaataacggcgacagcagctacccaggaggcagaggctctgctcggcacttcctgggcctcttcattctgtccggcctccctgctggtccttcacagactaggctggctcctacctccaggcctttgccttccctatgccctcctccgggagcactgtcccctcagccctggcaagactttgtttaaatcatttcccagtgagaccctccttgagcaccctattaaccctgttccatgctgcacccccaccccttctctgggattcatttttcttcaagtgactgacatcattttctgacatgcagcctcatttccttgtttatcatattcactgtccatctccacattagaatccaggttctgtaagggcagggattttggtctgttttgttcactgctacatctccaaggccaagcacagtgccaggcactagaagctgttcaataatgtgtgttgaatgaatcctatttcaccatcacagtgacaccaatcaaaacgaggtgttgaggctcctcccatttcatgaatgagaaaactgaggttcggtgagggtagggaactgtctatgcacagccagccagtaaggagtgaggaaggaagatgtgtgcaagcgcaggcctctccggtaccagagagctgtctcctccccacccctaacccagccacttacaacttatgtgggaaacgaggagtttgggctcaatgatttattgccgaggctctctctcctgaggtctgaagctcagttcaagtccataaccatttcctcataggaggcggagtcgcaggtggtttggggcactttctctggaacagagtttaagtcccatttttcccactcagccctgggactttgagacaacttctcaacatctctgagcctccctttctttcgtttgctggctgcaaaacgagaatggtaatagcgtatctctgtaggggcgttagcaaagacagcaggggatgcgtgtaaagggcttcttacagtgcctggcacacggcacctgtgagctgctgtcttggcactctgctgatgcccagggctgtcctcgacttgccccagccgggcccaccaccactgaatctcccggggtgaggaagcacccctggctcctttcatcctctacatcggccaggtctggatagttcagcctctgggaggcagggtagggcccagcgggccatgtttgcagcccagcaaatgttcctggagccttgttttttgttctgttgctgggccatttgtttttatagcttatcgtttctgcaggggggctttgaaaggctgccattgctccagtggacgtttccggtgcgcctccatcaagccacatttaatgaaaaccagtttaaggtcttctttctcataaaatgtctcattgttgctccggcagctcctctttagaataatgaagatgaacgcttcctccgtggggtagcacacaaaacccccagccgtaggagagctttgctcagtccccaggaagtctcagagaccaggggagaaataaaaagctagtgcagtttctattagggaggaggagaggtgggggcttaggaaccctcagtgctgcaaatatagggaatgaagcttgggttcctcatcctctctgaaggaattgtcaaatgaaagaattttgctactaaaagcgttttataagaccctcaacaaacacttgtggtccaaagaagggaagcagcagacgtaaggtcacacagcagagctggactagttggggtagagctggggagacaagcagttttcctgggtccccatccagacctccttctgctccagaggacccccatgagacagggccagggggccttcttcaggctgtcaggtctagcccggagttgaagatgcctgatgaggatctggctggtccacaataggggctggggaagcagctggtggccagtttcacagacagcaggaggtctcctccaaataaaaatcacaaggattttagatgcacttgttgaatgccaggctgaagtgacctgtggcccctacattccaggggttaccagctgatgtgaatgcctgtgggtgagatctagtcctcccaaaacatgccacatgggcaatgccctccatagcagttgtttgaaaaggacctagtgctcgtctcccaacgatacattaatttttctcctttcagattaaatttaaataaatcattttggaattactctactaattgactatttggtcagttgttacaggagatgtaaatagtgtggcttgatctgggttttttgcaaatgagacatggccttttcccctctaaatgtgtctacacagttactcttaatttgcccattcattgccccatgtgccacacttgctctcacttaagtccctatcttctgggctagaaaacaagggcagggaaaaaccccagccacacagacatacgtgtgtcagcaaggagctaagcatggccaagggcggggctggagagaaggcatccaaattctctgtctaccccagttctgacaatcaaaagctgggtgtccttcgatgggccacttggcttctctggaactcagtttttctactttaataacgtgggtggcttagatgaggggtcccaaatgtgcactgttcacatgggtaccaggcaggcttcttaggagtagaaggcatggtggcaggcaaactgggagagttcctgggtcaactaaagagacagccaccacctctccctccagccaatgttgtttttcagaaatggagatctccagcagccagatccttcatttctcaaaagagaaaccccaaacctagagttttatgtgaactaccaaattcctacatcttggcaacaaaatcagatgtgtaagacaccgtgctatgcaggtcaaacaaaatgcatctgttgatctctaaagtaactccggttttaaaaccccataatccatacttatttattacagaaaaagagtgtgtattaaacagagaactgaatttggctgcataagacaggagttagagtcctggattcaccactgactcaaagaacctatcacctcgagcatctgatctttctatgaaatggtgtttgcaatacctgtcctatggttccaccagtagcctgtgaggacgaaatgaggtccctcctgcaaaaaaaaaggcctctatgaagggtagaataccatgtcctggttattcttattatccagaaattcttctcttcaccactggggaccctgaggcctaaacctggaacttaagcagctgtctcccaggcagctctccgaacacaaaatgcctgagacaatatggaaaccagatgcggagcaaatgccgccttaccttttttttttttttttttttcctgtgcttttgtacgttttcaaagcctttccacattcatgggctctgatatcaataaactcacagctgctctgcaaggctgttatatcaggtattattctattccagatgaggaaacggaggctcagagctaagaatgattgggtcaaggtgccagagaaagtacatggcacaagatggaagccctgtggcctagactgctgtctgctggcagtcctctctgggtggttgcctgctttcaaaagatgaactttctaaatataggcttaatgcacagggccctgtcctcagcgagctttgcagcagctgaagcatcctagtacatggttttggtagtgaggatggtaaaaacagcaacagcagctgcttctggtcaccaccacctcctttctctctctctctctgcccccaacccccctccccgacacacacaagagagagagagagagagagagagagagacagagagagagagagaggggaaatactatgttaataggacacttttctgtggcttcttactgcacattgtctggaccatactctttgacaggacttcccacctggtctagcctggtcctgtgcacctttgccctttgcaaccttccctgggctcatgctccctccctctctgctgaaccttcttgcagtaatacttgcctcattccctccctctttaaggcctttgcaccacctgtttcccctcagctcaagtgtcactgcctccaggaagccctccctgaagcctccattcttggtcatattcatctctcataaaatcatggtcctttccttcaaagcccttattcccatttgtgcttgtatgtttgggtgtgtgattatctcacttagttccatctctttcactgaaatgtaagctgcttgagggcagggcaatcagccctttgtattcaatgtcacaactccagcaccagggatgatgtgcagtaactatttgttgaaccaatgcataaataaatatgtgaattaggtaacatctacctcatgtaattctctccacacccaatgagatattatgaattgttattcataatatggattcataacaatggatgttatgaattgttccttgttgcaggggatggggagaagactgagagtctgagatggtcagtggcttgtccaaggtcacacagctagtaagagatgggggaagatttgactacaggtctgcccgatttccaaattttcaaacagatataatttaagaaataggggccgggcgcagtggctcacgcctataatcccagcactttgggaggccaaggcgggcagatcacgaggtcaggagatcgagaccatcctggctaacacggtgaaaccccatctctactaaaaatacaaaaaattagccgggcgtggtggtgggtgcctgtagtcccagctactcgggaggctgaggcagaagaatggcgtgaacctgggaggcagatcttgtagtgagctgagatcgcgccactgcactccagcctgggtgacaaagcaagactccgtctcaaaaaaaaaaaaaaaagaaagaaagaaataacatgataagcctctgtgttagccatggttttccagagaaacagaaccaacagtatgtgtgtgtgtgtatatgtgtatagatatacacacacatacatatatacacacatatatatacacatgaatatatacacacatacatacacacacatatatatattatggagggagagagatttatctcaggaaattggctgctgggcacggtggctcatgcctgtaatcccagcactttgggaggcagaggcgggtggatcacctgaggtcaggagttcgagaccagcctggtcaacatggtgaaaccgcgtctctactgaaaatacaaaaactagccaggcgtggttgtgggtgcctgtaatcccagctactcgggaggctaagccaggagaattggttgaacccagaagatggaggttgcagtgagttttcacggtgccactgcactccagccttggagacagagtgcgattccgtctcaaaaaaacaaaaaacaaaaaacaaaaacaaaaacaaaaagaaattggctcacgtgtttagaggtaaatccaaaatctgatggggtaggctggcaggctgaagacccagggaaacatttaaattcaaaggcagtccactggcagggttcctccctagtctctgttcaatgaaggcctcaactgattggatgaagcccagcacattctggagggtaatcagctttactcaaagtcctccgatttaaatgctaaactcgtccaaaaaaatatcctcacagaaacatccagaataacgtttgaccaactatctgggcactgtagcccagtcaagttgacacataaaattaaacatcacaacttctgtatacccatcactcagattcagccattatcaatgaaattgctacatttgctccagctggcccccttcttttctttttttctgttggtgaagtgttttgaaacataccccaggccctatatccttctatcccaacctactttataagtcaagctatccaactgcaaggcatgcccatagaaccccgcacctctaagagctagctcggtcctcaactgtgagaaacctggcctctcagagtgcagagaggaggcttcctgatgtgtaggcccaatcggcatgcccaaaaggtgaggtctgatttgtgagacaatttccacagtcttagaaagaagtttcctctatgccccagccacgtctgtttataacttgaccttggccaggggtggggttgggggcagggaaaaagacttgcacgttccactccagcaaagcgctctctgtttttccatggccatacattgttttcattttcatgttgcacccgcctgctccccatccatttattgctttctcctccttctcttttcccttcttcctccccctcattcttcctccctggctttgaggcgtctggacttttgcacaccagagaaagaaacctatttaatctaccatgtttacaagctgcgtaaacaaggtacagtgagtgaatcatggaaaaaatgcactttatgtgaaaaagttcattatatgactttgttctattaaaacagccgggtgtaactaaccccaaccagagaatttggaaaaaaggaaaaaaaaaaaaggagaaaagaaaggaacccctgaaaatgccctgttagcatttatatcttacaatttcacattagcattcatataatttctgctggtttaagaacatttaaatggagttctcctctagggagaagatatagggactcattttctgttgctttctaataatctcttccttaaaaatatatacatatattttttaaaattgtcccagtggatttaaggaaatagggttaaaaaccaaccgactgaattagttcttttcttgagttgttgagtaattggtcatcattcttctaccttactctcattttgtttgggtcttctaacttaataatttctgtgtcgttattattgtggggcttccagattttttttttttttttttttttttttttgagatggagtctcattctgtcacccaggctggagtgcagtggtgcaatctcggctcactgcagcctccacctcccaggttcaagtgatgctcctgcctcagcctcctgagtagcttggactacaggcacacaccaccatgcccagctaatttttgtatttttagtagagacggggtttcatcatattggccatgctggtcttgaacttctgaccttgtgatccacctgcctcagcctcccaaagtgctgggattacagacatcagccaccacgtcaggtccagatttttctatttttcttatgatgataacaatagcaagttattaaaatgcactggcactatgctgaacaccccacattaagaattttatttaatcttcacaagagccccatgagaatatggaggtattgtggggttaaggaactggccccagttcatggttaagaaatggtagcactggctgggcacggtggctcacccctgtaatcccagcactttgggaggccgaggcgggcagatcatgaggtcaggagatcgagaccatcctggctaacatggtgaaaccctgtctctactaaaaatacaaaaaattagctgggcgtagtggcgggcaccggtagtcccagctactggggaggctgaggcaggagaatggcgtgaacccgggaggtggagcttgccgtgagtcaagatcgcgccactgctctccagcctgggtgacagagtgagactccgtctcaaaaaaaaaagaaatggcagcactgaggcttaagcctcacagccaagcatcggcatcattcaagtctaattttctaagtaagaaaagccaattggaaacaatgactatgttaatagtcatagaactaactttaggacgtgggaatatgagtgacttttagtttcttcttcaaattttattaaaatttccaaattttccatagtgaattatggaatagtgcctttagaactgtttcatggaggaaataatgtaatcctgcctaggcttaactagggaaaacaatgtcttttatgaagtatctaaatacatctgagaggaaataatacacatctttgcataattctttgcatatactgaggtagaatgcggtgttctagggtgtagacgacctggactatcttaccatccatgaaggcaagcgctttccctttcctgggccccagttgttccatctgtaaagtgagactcatagactgaaatggctttaaaaggctttttcataaacttctttgtttatgaaaaaacctctttgagaccaaagatggcctctttgtcaccaaatattcaaagatactgctttatgggagctgatgacatccttaacaagtagaaaggcctttcaggcattttccgtccttccattttgtctgttgctttcaagacagaggtgcagacgggacctgaaggagtgagtagccaggctgaagccggactcctaggaactctgacaagagacacaggcctgtttttaggagacaccaaatggatgataccctctcctggggtgtggatggtctcaggctgctgtgaatggccttttcctcttcttcagaaacagcttcaaaaccttccttaatgacaaaacaaagacatttgcaaactgcatggttcagagtcctctctgctgcttcccagggggctgggttcccatgcatgtgtcccttcccccctccccccttccccgtgctgcaagctgcccttgttttaaaccaagagttagggctcagcctaggggcactgtcagcctcatctcagagcacctgggttctcaaggctggcaaatatctctcttcccaggccccaagagaggatgcagctgctctgcccgctaagctttcagcttaccccagcctctggaaaggaaggagggggccttgggctgcctgtgaggtggggcccaaagccagcccagagccctggctctcagacagaaacttcaccagcgattctgaggatcccatttcccaccaccacgcccagccaccttggggaagtcagcaccgagagcagtggaaacaaaatcaaaatgcaggcacaaataagatgaataatcctaataatttgagacatgccgcccttgctaaaaggaccataaagggcatttgtttctaattaaacaccaaaaccctaaacctttcaactctgcatccacaactactgtaaatgtttatgaaaaacgggaaattctcgtttaattcaaaccatgccagaaatgcattttcgttgtcttgaccggtggagaaaccctatcggccccagcttgagcacatctgagctttaaattgagaaaggcaacaggcctgcaagtgaagctgagtcctgagcaagacctgggtgaggaaacagcatctcctcatcatggccaactctcaaatgacaccagagcaaatgcttggagcgtcttccagaaagagaaatgggtaccagggccgcttgcaatgttagggggagggtcacagacgtctcagaaataaattaggctgcccagcaaaatggttaaaagcagaagttgtagagtcacacaacttggttggatcaacctcttaccactggggtgatgtgggcaaaatagttaaactttctgtcttgggttcttcaagaatcattgccacagttaagtgagatgaagcctttagtgtgacggcaagtgaacctgcaaggcccctgccttcatgaagctgacgggccaggcagagaagcagattaatcagcaacctgtgctcagctctagagtgtctccaggtagcttttccagtgccctctctacctgtggagttgctgaaatccgcgctgctcgctcagaaaacgggtcaccgaggaaagatttcagcaggaaagagcagcccattcaataattccaaagtgactgtacccagggacttgaggaaccttaaatgcctatcccccaagccccacgactgagctcacagcacccagagaccatcacaatgaaaagtacactgggctgtggaaactcccggggcaggaggaagctctgcctccttaatcagaggatggaagccctcccttggaaacaaacatttcaatttggctgagaaggacacagcagggaaaaagcctccaggactcacgtgactgcatttcctaactcttcatccagctttaaaaatcaggggatttcctttgctagtctttggggaggagggttaggacctaaaatctaggcctgagtaccctttctctcactgcatggatatttccactctaacaatgtcaacagcagcctttcaaaagcaaagagctacagcctctcagtgccccacatggagtcacgttactgcctgctaggcacggggttttgctccacagcccccattcaccttacttccaggaagacagaccaagttcccacctcctccactttctgtccagaagctcccaccacccccataagctccagacatagagcatatgactcaacttggccaatcacagcatcacattctctggcctgcagtgattcaatcaaatccagtgagaggagctgagaattttgctgaactactgcaggaaaggcacctgctctttgcttgtggatctgaatctggaaggatgatggctggcagccatttgctaccaacagagcctgaggaggtaaccaacacacgcaggacaggagagactcagggtggagacaaatagctcctgaccacatcatctgagcccctgggacccaccatgcatgaaggcgggtctcaatcttctaattccacaagccaataaatcttctcatttgcttaagtgattttgagctggtttttctttttgcttgcaaatgaaagagttgaaaaagggaagagctgaataggggatagagaagaggcaaaggctatgagtaagatcaaacaattatttactgcaagtctactacatgcctggcactgcactctgttcactatgggataccagacacacacatagacccagagtttacaatcttttaggagagatgagacatgagtttgagtgactgtaatataaagaaaaaatatgacaaatgctgtgagcagggaataaaaagttctgctgacacacaaggagtgagagccttcttctggctttaggccaggaaaaggattcatggagatggctcgtagcactgctttgaagagggctggaatttgacaagcagaatttggggtggaaagtggcagatggcccccccagtggaggggacagtgtgagcaaaggtgagagagacatgttctagaatggcagacatcgtgttgacagacaagcaccaggggaaacaaagggcagacatcaggaattctgcagggtcctggccagggccctcccttcctctcagggaacctcaaatgtctttgtctctatactgcagccatattctggctgaagttctgtcatcttgggttgctgagggaagggttttctacaacagatatcagcctgcaaaggattctagcttttgcttctcctggccaccccttgggggaatcctttatatattaagtagttgccatgtgagatctactgccactcaaagttaaacagctcagttggcactctccaaagtctgcttccagcataaacccatgccacatgggcaaaaatccatttgggaaaagactgggaggagcactccagtcaaaaccttacatggtctgatccctgccaacctcttctcactccatggccccctctgctttctgcattccctatggcttccagccacaggacctttgcacatgctgttctctctgtctggaacaccacccttttacctaagcaactccaacttatctcttagatcacaactcaattgccacttcatcatagaagcctttgctcgtggccctccagggctcaaggcctcccagtacaggagttaaagacaagggttccagagtcagaatgcctgcgttgaaattctggctccagtgcttactagttttatgacctttctgtgcctctgttttctgatctgtaatattggctaattaacggagaggcttgataatggcaatagtgttggcagataacactgaatgaacatgagctaccatcatatgatttcagagcaacttgtcctgcctctctgcctagtcacagttgcaagttaatgcattcatgtgatcctttgattaacgtctgtctttgccaattgactaaatgccctactattaataggtagaacaatgtctggttttgcccacctctagcacttagtatcctgcctggcacgtaatagatggcttaaaaatatttcagaaatgcaggtatgaataaaagaacccagagtggggaaaataaggtcccaaatattcttatatttgcagaaaccctgacctcaaaacgtcactccaaataaccaaggagcaagacctcaaaagttgcaaacatctgtggtttcaaagatgaataaaacaagttccaaaagatgctccagccactgaattcctctttagcaattcatttcctgaaaagtggacatgaggctggagtaaatgtggccagccaaccagatgcaatgctctgaagttaacagaagtttgtctgatgtgcatcaaatgactataattccttttctagtatccctaacagttacagagaggtttctgtgagtgtggcctttggcccagattttaaataatattatgctttgctgcaatgctgttttctgagagtttacatctttggggtatgtttttaatatgcgcctcataatgggccaaattctcctctgagatccaagctagatctcccaagtacagactatgttatagatctaggggtaaacagtggtttccatgtcaaacttttgatccatcattattctgtgatcctccaggaagaagggctcagatgcagatgaccaaaagtgggtacagtttgcagggaggcattagtatttccctttgcaaaacatgttagtcccacagcaaggtctggagacacagttgggcaggctgagagagcaggagacccagatgctggagccctcaccttgggatttaccaaggcatgtggctccaactgggtattggttttccctggagcagggcatggccttttaaccagttttccctttttcatgctcccttaaaccagtccagcatctccctatgggcctggaccacagagatgcctttcttcctgactcctgagccttctgaaagtttttccacatttttctccttccaagaaagcaatggttctccaactcagaggttctgatttcaggaagcatctgtggagtgtagctctgagaagaaagcacccaaagtggtgaagagtagtgtgtgcatgcacttaaggcccatgccctcctagggcaggactgaagccatagctccaggtgcctgtaaaatccagaactcacaacctcagggttcctacctctctacctcattttaggtctcaatagctatctgtttagcaactaagttgttggtttccaccatgctacaaatcaaattagtgacatcagacaacacatgtgtccccaagagacctggcccatgaagtaagactggaagtccccaatggatggggcctgggcactgtgctgggctagactgtcaggggtgcaacctagatccctgcaaaactccccatggagcggcctcagaggacaacaccctcagtctatccatcaatgtcctccttgcctttggcctctctccactggagatgtgaacaaagagagaacaagagagattaatttctttttaatccttcctttctagcaagggcttgacctcaggctttggcctgtttcagcttctccccaggcaagaccatatttcacgctgaatcatcagtttctggggaaacagagcgctagcccacagcgtacggatggccatgctatcttgaaggagcccacaggggctgctcagacattatctcatccatccctacccttggagcaaggtgggagcaaggagccgttatcttggttgggctgctgaaggaactttagcccagagacaaggtacttctccggagtagtgcagtaccaggcccttcctagctccaggaaaaccctcagcagccccttgcttcttgggccagaggaaagcatggtggtgaggaaccctgcagaccttgactactcagctctgccactatgtctcaagagcagccataggtcagtgaacaggtgtggctgtgttccaataaaactttacttaaaaaaacaggcagtgggctgacattggctcacaggccacattttgctgaactttgcccctagtataaggctatttcttgctcaagaaatgatcttagaatgtcaggttggagcaaggtttctcaactgcagtactattgacattttaagcctgataattgttgtaggggtctgtcccatgcaccttggtctcctggagccctaagctgccatgtaagaaattgcactacccagagagaaaccacaggagaggctctgagagtacatggagaagagggtcccagaggtgcccagcctgcagctgaccccaccaaggcccttggcatgtgactacagccatcttggatgctccaacccaggacagccaccagctaagtatcactgagggaccacactccgtgtccacatggagtcaaacttcccagcttagtgctgatggaattcctgacccataaaattctgatatgtaagaaaatggttgtttaagccaccaagttttgggggcatttgttatacaacaagaggtaactggatacatttcagcgaagaatgagaaaaatctgtcatttagccaaaaatcttaccaacctaggttagaaatctgatcaaaggggaactaaatgatcagaaacccactgtggtggcagaatattaggtcactgtcttggcagattattggcccagtaagcccctaatattcctttagtgagtacacggaacctcttctcccaacaagactcggcctttttggggagggccctccacacctcctcttcatggcttgggaaacctgaaagactggctcatcaatatatcgatggccaaaggcaaacatggcttcaccagttcaggcagaagctttagatgatgtcggcacagtcacagcagaaagctcaccaaactactgctgcttttctttaaaaaaaaaaaaaaattaagagcaagaagaaaaactttgggctagaaatcagacatcttgggatttctatcaccatggaagatgacaagctatatgacctttggcaaatttctttacttccctggtttttcattttttccgtgtgtccattatggctttggacaagctcagaggttttcatatctactttttggaagcccacagaaacccctcagaggctgtgggtgcatttctgtgggttagagggtaggtaagagggaagacttggcaaacggggctccaagtcctctagcttcatttcactcaaaggcatttatgggcatttgtcagaacttaatttgaaactgaaagctaaaccatgcctgcacatcactggtcttcacagtttgtaaggtccttctagaatcctcatccctaaattctctgcccctaattttgatggggaatgaatgtggcatttttgtgtatctattttccccactgcccttttcagaaaggtaggcatggtgggctactcgctttttttcttgccctgtatccatcctcccttctaataatagcacccccaatttactctgggaaactatccaaggtctactctcagtccatgacccatctgagtgggagcatgtgagcagacctggtctattaaaatgcagcatccccttggccatgccatattattaagtcatgaatgggcacagaacctaagccagcccaatgagagtctgccctgaattttcactggaaccatcataaaagtggctatctctttgtggaattgtagaatgctagcctggagttgacagaagccatcctgccacctcaatgtgaaaggcagtttaagaatgaatcccacctaaaggagtggaaagccaagtgaagaagaaaatacagcatcttgatagcatcgcctgggctgctggattgagctatacctcaaggcaataggtccttggattttctagttctttaagctgaaaaattctcccgctgccttctttttcttttttgagacggagttttgctctcgtttcccaggctggagtgcaatggtgtgatccctgctcactgcaacctccaccttcctgggttcaagcgattctcttgcctcagcctcccgagtagctgggattacagttgcccgccaccatgcccagctaatttttgtatttttagtagagacggggtttcaccatgttggccaggctggtctcaaacccctgatctcaggtgttccaactccctaggcctcccaaagtgctgggattacaggcatgagccactgtgcctggcccgctgccttcttttttaattaagctaatttgagttgagtatttgtcacttgaaactaagtatcttagctaatagaagaagtaaatacagtttaattgagtctgggatgccatataagaaaagtccaagtgttttgcatactctgcttgcaaagaaaacaacctcccaggttggtggcctgagggtttgtgcaacaccaaagaacaccaagctcagccagcccaattgccctcccatcccttttctttttttttcatttctttccagctgcacggtcttttatggagcccatctttctaagacattcaaaatgacatgctattggaagacatttctgtccatgctaatacctgtgtttaaatttttttgttgttgtttaaaaaaaaagatcatgatatgatagcaaatgaatgttggcaaattgccaactgacaggtgtaaaattttatgaacatgcacattccaaaggaatgtggaaataagccatccactgtagtccagtttggcagaaatattacaaaaatataagtttggcatatattgtaattcatttaaagatgcttaaaaacccatccatcaaccttgcacagaaggtcaaagaaacacatgaatcccaaataaacagcaactgatgtacaaggaaaaggcctgaatatcagctccagataccagagagactgtacacatatgaagaggatgaaggtgctgtttggaaggctgagcttctaaaaccttcattggtgtttaaaaagaaataataatcatttcttagcagtaagtaaggtggactgttgccctctgcgtggccatcagaattctgctcctctgggagaattttgctgaagaattggtgagtatgcatcctgagtgtctttccttttttttttttttttttacttcaaggaccatatctgcaataatcaattgctctcacgtatttggtacctggacactcttcactttgtcacaagcatgaagaaactaacttacttcttcccagccccaggatgggctcccaactgggacttggccagtgtgattactcaacctctggtcacagtgatgggttcaaggttgggtaagtgctccatttgagtcttccatgagatctgataagagaacactgagagagagagacagagacagtgacagaggatcccttcagaatccaaagcagaaagggccacggaacgtggagaaatttctatctttcccccagccatctaaagggagcttcctgtagaagggaatgagtccaacatgcagagagaagcagagaagagagatgaatgcaacaggggtgggagagatggaaagatagagagatagacagagacagaggcagagagatctgagaaccagctgtgcctgccaacagagccactcctgcctgggctcctcagtaacattagccaataaatattcttttcagcttcgtttagttttgagctgggcttctgccacttggaactgaactaattttcactgatacagttacccacaatatttgcagcgtgatcaagaccataagagaagttggatacaggaggaggatgacacggttcttacttcaaaggaattcacaatctaatttgtgttcagtttggtaatggtttgctaagcatctattctgttctaaggcgcggtatctggtgactccaagatcaggatgacacagatctcatcctataggatttccctgctgagcaatggggtggatgtctgcctgatgttttgaagacggagagatctgttattatttggaactaggaaggcaccattctgctggagaggaaggtgaacaaagtctagaggaaatgaaaaagcttggaggatataaacttggaagtctagttagagtatttcataccgtggaaaattatttaaaagagattgcaaaatattcatgcttccctgatgccctctagtccccaaattctaaatggcttttttccacccataatttaaccagttgtgaaactgaggtgcgctttatcataagttgtttaaatgcttgagattgagcttccctgactgtaatatgggaataatactcacattgcaggattcttgtgacagagacactgccagctgtccactccactaagtacaccgtccttcttagttatagagtttgttactttcagatggacacacagctattagaataatgactacatttcccaggctctgtcacagctctgtatagccatctgtctaaattctgactaatgaaatataagcagagggactgcaaatagtttctaagaagtgtccacagaaagaccctccctctttgacccatccccattcgtgtggccaaaatacagccactaaggctggagcttgcgagcaaccattttgactcagaaggcagaatccatgtcctaggacagggatcagcaaatgttttccataaagggtcagacagtaaggatttctggctttgctggccatatgttctccgtggcagtactcaactctgctgctggaatacgaaagcaaccatgcataatatgtaaacgaacgagtgtggctgtgttccaataacacttcacttataaactcaggcagtgggctgcaggccatagtttgctgacccctttctctaggatgggagagcagcaggttaaaggaacctgggaccctgatgacattgtaacacccatcacccagacatggactgcctcccaccagatttatatcatataagaaaaaaagaagtttcacaattattttagcattttctgtcatgcgaagccaaacttaattctaattaaaatagttgtttaaggaaagaataagtgatgtatataaaatatccaacataaatattagaaacaaatggatattgaataaaataggtatttcataataataaccagatagctgtattcagaaaagctttaacccacctctaagttaagaacatagtggctgacgggtactggaagcctgctgggaagagaggagagaggtccaggccacaggcagagtgtcccctttctgccctttgccgtgcacttgtctagaggggtcagtgaatccacgttccacctctgcatttccctctaatatatcagcatggtactccttcccagcctgctgagatgctaccatcaggactatcataaaccactcagaaaaaaaaaaagtgctaaactttattaaacatcataaaaaaaatgtgatggcctagatccatgtaggctcacttgggttagagtgcccaggcttggccgtaagtcactctttggcaaccaaaaccacatgaaacatcgtgttgaaaacttgctaaatcatttgtcactcaaaggcttttaaaataaaatactttcagaaataatcatttgatttcagactctgaactgcaggctgccctgagatggatgtaaatactctgtctgcacaggcacattcaatagcaactgaaagcagggcgagtcaaaagtcttttgctgctaagtttcaaatccaaaactacacttctctcaaattccaaatttcttcttccttatatctcaaatgaaattgttgcacccagcaaggaggcagagtggtctcttagcttggggggaaatgtcttagccactgagtattctggctctggatggagtagcttgactttcactctatgatggactccattcattgaacttcctatggtatatcaagagcatctacttggtcctaacagtgtgagttcaaatcctggtttcaccacttaccaattgtgggactttgagcaaacccataatgtcctatctgcgattgtataggtacatgaagaattaaatccattcattcattcaccatgaaaaatgtttttacacacgtactaagtgccaggtactatttgatgcgcaaggaacaaagtaggcaaatagcctgcatgtatcaggcctggtgcaaagtaattattcaatgaatgcttgctgttactatgctggtaattctatttatttatttatttatttatttatttatttatgatggagtctcgctctgttgcccaggttgaacaggttggagtgcaatggtacaatctccactcactgctacctccacctcctgggtttaagggattctcctatctcagccttctgagtagctgagattacaggtctgtgccaccacccctgtttaagttttgtatttttgtagaaacaaggtttcaccatgttggccaggttaaattcctgacctcaagtgatccactcgcctcagcctcccaaagtgctgggattacaggcatgagccaccgtgcaacagattgttgttctattacccaggctggagtgcagtggtgcaatcttggctcactgaaacctctgcctcctgggtttaagcaatcctctcaccttagcctcctgagcagttaggattacaggtgtatgtcaccatgcccagctaattgttttgtatttttagtagagacaaggtttcaccatgctggccaggctagtctggaactcctgacatcaagtgatctgcctgccttggcctcccaaagtgttgggattacaggcataagccactgtgcctgaccgataattaattttcaaaatgtatatatatatatatcagaccatattccaagtgctggaaatccagagcgaaataagagaagaccatattctcatagtacttgcatatggaggggagggcaggcaatatacaaatatgcaaacaagatccttccctatggtttattgccatgaaagcaactagccagggttatgtgatggcaagcaatcaatgatggagtggtgaggagagttgtgagttggagaaactgcttgaaccaccatgtgacaatctggaggtaagcactccaggcagagcaatagacctgcgcaaaggccctgaggccagaatgttgggaaagagacaggaggccagttaaacaaagggaagagtgaaataaggcaaggttggaaaggtgggtaggtaccttatgggacatggaagtcctcataagtcatttggattgcatccaaataaaatgagattccactggagggtttttagggagagcttgatctgattttcatttcaaaaactggtccttctgagcgtatagagactacggtggaagcaggactcagctgggaggtgatggtggcctggagtgggtggtgaatggtgagatggtaagaaagggacagtggtgaggctgacaggaggtgagagaggagggagaggtgaggatgatgccaaggtttttcaggaggaggactgcatctggagtgagggtgagaaggcactgagaaggagatttcccagtggccaatggaagcaggatccggggccctgatcagggctttagagtcatcacccatgaagccagggggagggatgaggtcaccacggtgattagtgaagtaacagacagcagcctggaaaatttccttccggccttttctctcataactgttttatcactatctggtgagtttcactcctggtgatggcttccctctttgggcccttctaatctgtttccttttagaaggtggctgttttcagtggtttttcatttctttctctggactaattttattgctcataggcttctcttcagctgccttggcagggagatgctgtatattaaaatagttattattttattttatagctcagttgaatctatattctgctcattacaagtgtataggcctcactagccaagtacatttcataatggcaaactcttattgagacagaaatctcatgttctctcagtgtctcccaggaggttgccctctgaattgtgatgagtggtatgtgggcacgaggagcccacgggttggatcagtgctagttaaatcattgccctggttcaacttggccggggacccatgtggtctaagctcagagtgatgaggaggtagaagaggagtcatccagcaagcaatagttagcaggcatctcaaaattaatatgtccaaacctgagctccggaacatcatcatttggcttctcctgtaatcttccccattctggatggcggcagcctcactcttctggctgctcagcccaaaactctggagccatctttggctcctctttccttcatgttccacatccaatatttcagcaaatactattacctttcacttgaaaacccatccaaaatccaactgcttccctccatctccactgccatcaccttggtccaaaccatcaaacgtctgttttctgtattacttcaatagccttcctgcctttgcccccatcctgtttattctcacagagagaaatagccagagaaatcccattcagatgaagccagctcaggaccaacatctgccaccatcttctggtgacttccctcctcgttcacagtgaaagcaaaagccttcactgtgacccatgagaccctacacagtctgacctgctccccctctgacacgtccctgactgctctacctatcctcgctccactcatgtcacgtgtcatgaacacgtgctaggcacagtctcacctcaggggctttgcatgtgctcttctcactgccaggaaagccccgcccctagatatcaccaaaactcgctccctcaccttcttcaggccttcactcaaatatgacattctcacggaagcattcccttgggcctatacaaggaacttccaggtaatgtggttgagggggaggggctgcacattacctttgaacccacttcaaggaaatagcaccaaaactctagaagtcatcaccctcagggagaaagaatgcttatctataagaagcctagcacacaacagcttcccaacctatctgattaaacaaatacacatgaagaccgcatttggcggcaagaaaggattaaaaaaaactcctccaagattatcttgggctaaatctgaagaaggaatctgcactccttccattccgatggcatgtttaagttcagtggctgaaaaatctgcagaaccagttgggtccctatgccgaaggggcagggaagaggcatgcgctgctctgccaatggggaggaaaaaaatttaacgagggcaagataagagccagacgtgtggaaatatttctctttgaggatattctttgtaccaattactcttcaaagatatcatgttagcatttttggcacaacttgacaattaaattagacgaatcgttttcagtgtttttgcatttgatgtgcctgaaactcctcttaagctaaaatgttcagcctgtcacacacatttttttaaactttggcaagtcacatcaacactgatttcaattaagtcaagaatttaaaaacatttcactactcatctttttaaaaaattacatgacatataattaattgggtttgatgatcatttcgtggtgtccaaagtttggggatagaaagaaacacagtcaataaatttctattttggagatgacttcatttctattttttttttttttttttttgagacagagtttattactcaggctggagtgcagtggtgcaatctcagttcactgcaacctccacctcccgggttcaagcgatttctcctgcctcagcctcccaagtaactgagattacaggtgtgtaccaccatgcctggctagctttttgtatttttagtagagacgggattttatcatgttggccaggctggtcttgaacttttgatctcaagtgatctgcctgcctccgcctcccaaagtgttgggattacaggtttgagtcatcatgcccgaccccccatttcttatattcattgagtctctccatttctcccaggagccaatggggctttaaatctcccacccgtctcaatttcatgctccaaaattggttcttgtcctggtacttctggtcccagctcagtcataggcagggtagggcagcacgagaggctgtgctgaacgctggaaaggcccccaatcacagcatggtcacggtaggaagttcggccagaagagaggcgaagtccacatcttatctccatggttggagttttcctcttgctgatgtgacaaagtaacctgacgagataatgatttccaggttggttccaaatggtctgggatgaggtgagtgcagagggagggccagggggagctgcagccggatgatgcatggggctgttctgcaggacatctctcccaggagttcaaagggttctgacgatattctctaactcaccactggcatgcccggggaagaacagatggtctgtggtcagataaaccacctagactgggatgtgattagggtggtcaaggaaaattacaaaaccttggagcttccctttccttccccaacttctggcctctgcccttacacaagtcttgttttgttttgctttgttttccttgcttttgacaggctccaatttttcattttagtttagtccattttgaccagcattaataatgagaagtgggccgggcgcagtggctcacgcctgtaatcccagcactttgggaggctgaggcgggcggatcacgaggtcaagagatcgagaccatcctggccaacatggggaaaccctgtctctactaaaaagataaaaattagctgggcatggtttggcgtgcccctgtaataccagctactcagaaggctgaagcaggagaattgtttgaacccaggaggtagaggttgcagtaagccgagattgtgccactgcactccagcctggcaacagagcgagactccgtcaaaaaaaaaaaaaaaaaaaaaaaaaaagtaattcaatgtcttcttccctactggttagaaaactctatgatgacaagaatcgggtctgttttgtgcacaactgtgctcctgacagcctagctgtagcaagtgtggctttttattctgatgctgtgacatctggggccttagggacctgaaggacactgcctctcctagggctagctaactcctagagatagtaaacaattttgacttggagctcaccttttatatgcaaaccaatcaatccaaagccccgaccccaaccacttcctcccttctggggctcttctaggggtctcacactccagaccattatttccctgccccaatcaccctgggaccaagcaccagacagtgaggacaacaactacaccccagagtccactgaaattattcaagctagtcagttctaaacctgctcaccctgccttgctcgcctttcccacaaaagccacaacaaaggctcttgcccacgttttcccctggctccctctgctttctgaccaaacagaatagtcaaattctgtggagtgttcagaagtgtttcctgagtggtcctgcatgatgtggtgtgccttcccctcttggaattgtgagcaacaaatcatcttttcagtggcctcaccagacctgattaaaaataaaacctacattctaagacactagcacagggcctagcacacagtaggtgctcaattaatacctgcagggggtactgaatgagtctttccttaaatgtaaaagtccacaaaaacttcctggatactgttccctcttgcttcagccttgtccttccttacaagataatgtgaacaccaggccacctacctgggccgaaattcaggtgttccctctagacccagggagtgcagttcttcctgccacccgcagggtctgtgcagcccaggaaggcaagactgacggcgttcctgagggaggtggcgttgggacagtgaaggggcatttcctggctgcctgtcatcatgaggcattccagctagcgaggaaaacaaagacagcggccagggagcgtcgccttttatggttccatcctggctgcacttcaggagcagcccagaaagtggcctgggagacaggcaggctttgtcacccacttctgttcacctcggtccctgggccagcagctggagaaatgcttgtggcccggccagctagaggcacaggaacccaagggtgagaatttgatggcagagggaacacccttcctggcggtgtgctttcctcaatcctcaatatcatctcccacgagcacccatgtaggcaacaaaaagaaggagctgaagcaattctatgcttaaataacaccaggggccattttttggaccctcaggggatatctggaatcttctagaaaataacgaatatttattgagcagttattttacacaagctcctacatggagcactttgtattcttgacagccaagtctcacaataatcttgtcagcaaccccattttcagatgggaacacagattctgactggggctgggggacttgcctaaggtcacatagtgaagggtggggccaggtgtaaacccctgctatctagctttcccttaccctggagggcctccctccaatagtcaaattctgttaagtgtttaaaagccttagctggtgacctctagggttctcagctgctctctcattacagtgaggcagttgcccccagatgatcccactaaggggttttttctactctatcactttaattcagcaatcaacacttctaacaacacttctaagtactgcaggtcttcctccaggagctcagaaaccccagggcctctgaaaccccctttatatagaggctgtgtgaccttgaacaagttgcttaacttctctgggcctcagaaaagagaacaggtttgaccgcaaaacaccaggcaccttccaagtgttctccacttataccacctccttccccatcaacagtcttgtctcaaagtaaatatttctggtatgttatggaatgacaggacataacacagaaagatgtcggtaagaaatgggctttggtatggaacagaccaaatcttacctccaatgtttattagcaaagtatttagttttctctgtgcctcagttccctcatcagtaaaatgggtatggataatagcaattgttttacggggttatttgagaattgtctgagatgatgcatttagcatgaagccaggcaacagcaagcactcaataaatgttagccagccatttgattgttgaactttaagattcacttttctttttttgcatgcctctccatctggagtgatgatgtgaagagcaacagatgcgaggggggccaggatagtggggtctgcagcagcagcaccaagaggcaatgtcacagctagttggaggcaggccctgatcaaggaaaggctggggtaggtaggtgacacactgggccgctcctcatgtggttcgtcacaatttttatgactttcttttccatttgcacagccaaggagtcttcctccttagtcctctgcttgccagagtcagctgcctggaccttcctcagcccacatgtccctgcctcatctttaatgtgagtgcacacagttcatgcagcaatgaagcctgccacgtgccttcagcctaagtatggattctgtcaacacacttttctggagtgatgaagagccgtgaatttccatagtcctagactgcaagatctccctacctttaagtttttctgaattgagaacatagcttttatttgatgagggcacttgatgtagcgcttctcctcatcaccaaacagctgtcaataaatgcaagaggcatttaaaaattgagggaacacactcatttatccttgcatttgtacagagattaaatgctgtcctgccagggtcagtggcagtaatcatagcagttattgctattattagaagctacttggtgtcaagttttttcaaaggcccagggctttgcatgtgctattttttatcctggattaggtctggttattctcatgtgaccaatgatgacactgtggtccgtacaggtgaagtgacttatccaaggcttcacagcttcatagcctgggatttaaacccaggcctgcctggcttccagattcctcctgtttcatccataccattcggtggttgctattttctctgtcaattccctaatgaaatcttgggcaggactttcctttgccaaagtcccttgataaaacaaacttttatctcccaagtcatctggccgatgcatgaggggatgtacagaatggaccttcctaggaggaatgagctctctcacactagatatatccaagaggaaggacgtgccctatgaaaggggtgccaaggaagattcctgtggccttgggaagagctgggatggggggagataaaatctcaggtctgttacctactagttgtgtgaccttgggtgaggcactgtgcctctctaaggctctgctggctcagtattctgcatgtgtgcattgaggacaagagtcttgtagagccactgaggatttaagaagtttgcagggtgatgctcctaagagggctcaagtgatggtggcattgctaccatgactgagaaggctcgagttgatcactgaggctgtctctgcaagctccaaagtcccataagttctcttcagtgagtcagagcctagattaactatcacaagtgccctccagacacaggccagaatgggccctctgttttcctagggccagttctaaacccctagctgaccccactgccatgtaagtgcccgctcatccatggtggagaaaccacacactggaggagtggagacttctgggtcccctggctgaactactggctcacagaaggtgcactttctttctttctttctgtttttttctgagacggaatgttgccctgttgcccagactggagtgcagtggcatgatcttggctcactgcaacctccgccctcctgggttcaagtgattctcatgcctcagcttcccgagtagctgggattacaggcatgcgccactaagcccagctaattttttggtattttttagtagagacggggtttcaccatgttgggcaggctggtctcgaactcctgacctcaagtgatctgctcaccctgcactcccaaagtgctgggattacagttgtaagccaccacactcagccagaaggccagaggtgcactttcccaccctcttcctggtctgaccaccccagggttcttctgaccaacagaatacagtggataaatggggtcctgttaccagactgccttggttcaaatcttggctgctttactctgactagcccatgtgacctcttgaaaatcatgtaacctcttgattgcatcatctgcaaaatggggatgatggaaacaaacccagcagggctcttataagaattctttggagtggatgtatgaaaagtaagtaggacacagaagcccatcattattatggactagggtgctgggcccagttcctggccccagagggctccccaccagccaccatgatccctgtaggttgccctggctccaggccttctccagctccactagtggctcagctgaggggagaggaaggaccaagggcaccaaatttaccccctggctgaaacagtacagctttaggggaaaaccagagtagcaagagcagtcaaaccctgcctgggactttgtgccaagccctgggctgtgcattagacacatctgattgcttgaatcctcacctttataaacaagcacgtaggtacttttcctatccccacttacaaaggagtaaactgaaactcagagaggctgctcagtgatttgcttaaaggtcacacagttagtttataactaagctatttacctctataaaattctccaaaataggttgggtacggtggctcacgtctgtaatctcagcactttgagaggccgaggtgggtggatcacctgaggtcaagagtttgagaccagcctggccaaatggtgaaaccctatctccactaaaaataaaaaaaattatccaggcatggtggcacacctgtagtcccagctactcaggaggctgaggcaggagaatcacttgaacctgagaggtagagattgcagtgagctgagatcacgccattgcactccagcctgggtgacaagagcaagactccatctcaaaaaaaaaaaaaaataaatccaaaataaaaacattaatggaggccctaccatgcaccaggaactactggcagtttatacagattagcacacttgatgcccaaaataatccttcaggggaggtattgtgatgttattttacagatgaggaaaccgatgcttagggaggtaaaggggcctgccccagagcagtgatgcagcagggctcaaacccaggtctgccaggctccaggcacgtgcccttagcatatgtgtgctgctgcccaagggcttctcatcccaatttccagagcaaaagtaggaacatggcttttcctctgaactccgagccaagccaagagatagagaagcagctgcggaggaaacccccaccttgcatcctgcccgttagctcacagccgtcccctgtatctttatggcctgggctgacggccccgtcctcgtgcctagcccctcagcttcctgcccgaccccaccatgtcagaaaactgcagctccaaagtggcaacaagagtcagtcacaccgcatcgtgcgagggaggcttgggggaggatcttaggctgaacccaagctctcagggccctgtggcctttcctgagccctgttcagagtcctggcctctctgtccagaggagagtcttgccgtgctctgtcttagacaagtcgaggtgattaaagatcaaaagacaagctaagacgtctggcttgccaacaggctattgtctgccctgtcctcagcgccaacttccaggccccagaggcctgcgatcagcccctctccacccgatcaccttttctttcacaactgatttttaaaaaaatcccctcctgctcttaattgcatgctgtgtgttcagatttcctgaagttcatgaactgctgtgaaatttaagacaggtctgcattcccactgcattgctactttttaattctaaattccacccaccttccctaggaaaaaaaaagagaaaaaaaaaaatccaagctgagtgaaagaaaatttatgccagttgaaaggagaaggccagccttgaataattctactaataaaagggcagtgagagatggggtaaaaataataaggttatatcctcataaagttccctttatttgtgattcccgaggcacttggggaatgatagctcatcagggcagggtcccaaatgtagcatctgctccccagcggctgcctctattgctctgggtgctccataaacactggatcacagcaatcacaggcctgcaaggtgggctggtgggaagtacaaaccagaggaattttatagcaggaggaagaggagccaagaagcctaaagacatccccatagtcaccagataagtcaggctgaaccccaaacagaccccaggcatgcaccatactctaggccttggagaggaacctgctaggtggtggccacaggttcttcattaagagatgctccctaataacaaagactaggtcctagagggcttcatgtaacctccatgttcctgcgaaagaagaagggcacctctcccgatccactggagtgaaaggaaatggaagaggttgtctagactgccacagtatgagttggggtagaaaattgagagaagggctttgctgaggcaagtatttactaaggccctactctgtgctgggcactggagagggagagagaaaggggacgtggcccccactgcagggagctcaccaatacatgggaaacctcactgggtaaacagcaggctctaaacaaggcaggatatggcgaattctgtagcaagcagagaggggccttcccacttagggccatcctcatctgagttcccagcatctctcatctgacttctgcagtggtctacccactgggtcttccaaatttactcatgctgccttgcagcagcctagaaagttaaaaatgcaatgccaccctcttgtacagagttgtcaatggcttctcccagcacttgtaccaaaatacaaacaccctacaggactccatgaggtctggtccctgcgactctcccagaccttttctcttaccagtccctaaagcccacctcggggccttccacacacttcactgtgctccaggaaagctcttgccttggctcctaccacagtctgcacctcctttcattgaagtcttggctcacctgtctcctcagaaaggcctttactcagcgttttatctaaagtaacctggccaagtgaccctgttttattccctgcaaggcagatgtccttatttgaacttctctccttataaaaaatacagtgaaacaaatactatctacttacacattgcaagtctccctgtattagttagctattgctgtgtaacaaatcacctcaaatcttagtggcttaaaatagcaactatttattattgctcatgagtccacaggtcagttgggtgatatgtcttgtcttggctgggctcactcatgttcctctataagtggaataggtagctgtgctgatcttggcagggctctttcacacatttggggcttggctggctgtgacctggtctagggtggttttggctgggacaactgggctctcctgcacatggcctctcatctaccagcaggctagcctaggcttgttttcacatggttaggcagagttctgagtgaggggtggaggtgggagtggggagagagacagagagagagcttgagctcttgaggcttaggctgggaagtggcgtactgtcatttctactacattctgttggtcaaaggaagtcttaaaaccagtctaaattcaagcagagggaaaagagagctatatagcttttcccacttctttatgggaacagttataaaatcacactgcaaagggcatgcatataggaatcctgaaaattggggacatttttgcaattaacctaccatattcttctacaatgtaaattctacaaaaggacagacctcaatgagcacttgccatgcatcatacgcattttacccatactttgtatagtatatataattcacaatctacatttggtacgtttttcaatttgaaaaaaaaatggcatgaaccccttaataacactggattcagagacaaggttgtattctgggttagacaagttacaacaggcatctgctatatggagttgttctatgctgggagacatatttgccccatgggatatcaaaatccacataataacaggtcatgttataatgaggttttgctgcacatgcttgctctcaatttagacggcaggacctgccaggtcttcctccagctgctggcttcagacctctctttccagaaggataagaactacctgtcaaaatgcaaagctctaacaatgaaatatacagcgcatgctgtgggaaagccctcggtttacttccacaggctgcagctggtgtgcacggcagaaatgattcattcttccacccagcaaaacaagtccgtttacaggatctcctaaacagaacacatcctcaacctttcacatgctgcgcactcggctcatgatttaacctcctttgcgttgaagagccacaggctcagtgctggaaaagaatgctccttcctgcattgctgtctgctccaaggcaatatactgttacatttctaggaaatcagaatgtcttttaaatcctgcttcaagtatctacacattccatgctaagctgcaatgcttaatttaatatctccacggcagtggtgagggtttcaaatagagtccacagcctcagggacataggaagagaattcaaaaggtgatatgatagtttgggatgattgtatttaggttggtgcaaaagtaattgcagtttttgccattaaaagtaatggtagttttgcaccaacctaatatatttaagaagtggcaaaaacaccaaagtgggttttgccaccattgccaaaactgaatgtaaataccacttgacagcaataggaagcatattttttttttttttgtcttggggaagcttgaatcctactgagttcaatttggggagggggtagtgctgccagaggcgaaagaataaaggctaccactttgcgaaaatcttgagggcaagaaacctatttcagccacaaaaatacaaatgtcttttcaatgtcaggaaactctggaagaaaagacagaggatgggaccaagagagaccaaatgcatttcctttggaaatcactgcctggatcaggggtcctcaagttgttaccaactcccacaagagccctgaaatcatttctccaaatcacaggtgctaattgctttcataagggtgctggctagagcagaacccaagggcttggtaagtgtgatattctcatttctctgggcttgtgtgatgcttgagtttggaaggtaagtgtctggattgacttcatatatacacatggtcctagagatgcttatctttttcaaacccatctgggaacattattggtttgttaattcattaaatacatattgaatatgactcatgtgtgccaataacttttctgggcacagagaacacaacagcctatgtgcttgcctacatggggttctaaacaaaattgacattgaaatacatagtattctagatgatgataaaggtctaaacaaaccagggaaagggatgggggctatttttaaatagggtggttagatgaggtctcattgagcagataatacttgaacgaaggcttgaatgaggtgagggagtgagccaagtagttatctgagggaagagaattccaggcagcaagaaaagccagtgcagaggccttgaggcaggaggtgcctggcctgtttcaggagcccaaatgtgctcctctaactagggggcagtgctgggtgactctcactgatttggttggcccttgaaggagtcagttttaggatgagcatctcagaggggaaacaaaggtactatggtattatcaatctttctcttttcaaatgcttaagtcctaagtctcccatcgccacttcctttaaaaaggaaagtaagggggaaagaaaaccatgtgtctgaaaatacccatgcaataataccatttagcctggcccatggggaaaaaaggtgagacatctgggggtcatccctcaaggtgagtttatatactgtgcagattttttaagagtatggtacagtaattacactgatggctgattaactcaggggagttacccagaggtgaggtctttagatgtgtagggagaagtctgcatgcacaggtaagagtggcagggtttatggagagggaattcaccatttgtggccagcactatttccaggtggaaatggtgctcctctggtgaaagggaaagaagccaaggtttccaaccagtggtccttatacctccaattcatggacaagcttcaagaggtgcctgtgaacctcttgaaatgatatgcaacgtttcaaatgtgccacatgctttttcttgggaaaagggtccagagcttctcagaaatttccatgacctcttccaaaatgaagaaccattgacttcgcatggagcaacctctgttctcacttctcttccaggacaggtgggttagcagatgacccctggggagaactctgccatcagggagagtataaccagctcataacacatgagtcttcatctagagtcatgaggccgatcatttgtaatcaatacccaagaactttgaaatatacatgcatgctgtcccctccccacattccaactggcctgggctttatccagtcctgcagttatacacaggctctcatcaacctcctggcctctgtacaagctgttccccctgtctggaacactcttcacttttcctgtagctaactctcacacattgctcaggtctcagctaaaacaacatgtcccataggaagcaattcctcgtggctagactagatcatgggccccagtaacatcctgcatgtactctatcataccccatcagagtttattgtgaactctggtttcacagaagctttctctgctagaatttaacctctgtgagggcctctctcccttgacacagatccctgctccaagtaggtactcaatacaataggtatttatagttggatagatggatggatgcactgatcagttattcttctcagagtggcaacttctggacaccgacctgctctcctcctcaaacagtgtcaagtatctatgaagtggtctaccacactctgcaactgcttgttctcatgagcagttatatccagaagttggctatcaatattttgaagtggaatcttcttttttaaatgaatgatctatctcaatggctgaattttgcacagctaattgattcctatttcaaattagtttgtaagcaagctcagactaccgactgcctttgtatcatatcagtcttcacaacttcatactgtttttcttctgcagggctctgaccagagccctcccttgcctaaaggagtaaactctgtctttgaaaggattgttaaaacagacaggatcatataagaagtagcctgagttcaaatcctgacattattacaaatagctgagaagtcttggcaggtcatctagcatttctgagcctcagtatctcagcacatgatcaactcaatgtactgcatggtggtgaagaatacggggctttggagaggaagccctgagtctgaataatgacacaattcttgccagataagtgactttatgcaggttacttaacctttgttagtctcagttttctcatctgacaaagtgggactaataaaggtttattgcaaaaatattggctgcttagcacagaaactaaacatagtaagtactaattagttaatgtactcatgccattattgtatcatccttacagtggtaacaccaattgttatgctctgtggaccagctaagccaaagagaggggacttggatcatttactcgagctacccagactcttcagagtcaaagcaaaatgtcacattcttacccaccaaaagatggcctttgggttctgtgcattagtgaatatcaatctaaagaaatcacaatgtaaagtcaggcatctgttagctactggctggtttccagtgtggaagcttgcctgcctgtctgcctgcctgcctgcctgcctgcctgccttctttccttctttctttccttccttctttccttccttccttccttccttccttccttccttccttccttcctccctccctccttcccctctctcccttcctccctcccctccatccctctctccttccctccctccctccctccctccctcccttccttccttccttcctttcttccttccttccttccttccttccttccttccttccttccttccttcctagaaaggcaaggatgcactggacggtatcagcttccctattaatttactgagtacaagtctatgctagcaactatggttagtgctaggctggtataagatgacatgggcttgtggaagctgggggatctgctcagtataggtgatggaaccagccacgtctgtaatgggaaaatccctcttcccaagtatccgagagctcactgagttgcttttcccattgcaggcttcaaagggcagcagagggcttagaaagtacctttgccagcaagtccaaccacatgccaacttgctagcccccctcccaaaacaggtacagggttaggagtcaagctcccaagactttctgggatagaattttggcttcttcacttattatgtgattctggttaagtcactcaagcctcagttttcttacacataaaacggtaataagctcagagttgattcatcgttaaaagagctaacacatggaaagtgcttgttgaatagtacctggcacaaggaacacactcagtcgatgaccactgttactattcttagcagtaatgtagcctcagggacccccacagggaagcctattggtgaagagcttaggccctggagccagatgccctggatttgaagcctgggcctgccccttcttgggcaaggtactttcccttgcagactcagttttcccatctgcaaaatgggttcaataacagctcctacctcctggagctttaataaggacttaaagtattaacaggcatgcagtccttagagccacgcctggtttacatcaatgttcattcaacaatggctgctatgactactagttgtccatgccaggtgttctgggctcagttccttcctctacccttgcctcgccgagactcagaggaaaggcagtttccctggcagaatttccacttagatgaggttctataatcacacctctcctaccttcccacttaccctatttagtgtggagatggtgaggcattggggaactctgcttggagaggccagagactcctccctttctcacctgcatatgccacgtaaaccctcatgggtggaagcagccataacccacatctccctgctgaggctgccttgtttcaggagcacaccaaatacggtggggagagaaagatgtgtgtgggcaaggataacataagacagagagtggcacctcccgaactgagaagattgacaggggagcaccaccagcaaattgcaatccaccatgtagtacttgggcattcccgccccaagaaggaagatatccaagcgcatggcttgtctcaagctaagcagaggccctgattttatctcagagtcaatggacaacgagaaccagacctgcctgcaaaatacccggggagttacaaatccaaatacggtcttgtctttgctgtttcgggagcctgatgtatgtcaatccatttggtggggagaagctcaggaggaagcgaggctctttcgggcaggctgctgcttccgctgtggtccctaagattcagtgattagcattcctcggtttaccgtaaaattcaaacagtgccatccattcggtccagattctctggcctgatctaagacaaatagcacccggtttggcctccacagctgtttgtgctgtcaactaggcagcactttgcaagatgggttaacagatttaggactaaatctctaaaggggcctccatctggtctcctgtttctcctgttttagggctcagggtttttataccagtaattgcccttggacatcaagtggcccattaaatggctagatttaccaccgctgaactggagcttcattcaaacaaatgttccccccaataagcaacctgtcagttgtgacctcaagtggctgctggttccataataatccaactaacagtccagttaatcagttatagaaaaatctcccaacatcccctctcttcccctctctataactgttggggttctagatgtttaaaataaagtcttttgcatagggtgtggctcaaaaacaagcaagatttctatttgaattacccctgttagagagagctctttggggggaccctggaagataacaaaatcatgtaattgttattcccagtcatccaggccaagggtaaggctaccgaaggggctccgtgggtttgaggattttttgaccccagtccttcctttgcagccatgtgaactacctttttgattattaagaacacagagtgacctagaaaaagctgcaggtttcatggaaatgaaagatccacaaacaaacacagctggtttcggctttgatgctgataaacaaagcgaggcagagcagaaccgcagaacgaaaatcaaaaaaccagactgaaataaagtaaagaaaatcctttcttcccttagcctgcagccacaggagggaaggctccaggaagctctggaaagggcagcgtttgagagcagggcttcctggagaagagcctgggagccccgggggcttcctcctggttcacacagaggcccccataggcctgacttggaggcacactggtgcacctgaggtgactggcggggtggggagggagtggggactgcagagggttggggaaaggaccacggagaaaccaagagggggttgtattttcccaaagagaggtggccctcggactgtgagtctttgccttcactttcaatgccaacttcaaaccaccttaggccagcacaaaggcagatcccagccatgatgcttagaaaatcctattcataactcccatattactttgggaaaatagtttagtgtaactttatattagtctatttgactatgatagcagaaatgccactatgactgaaagcatcttaccggatatttccccattctaaattcacaaacataagaacgcaatctaaactagtcatcgagttggtgacctatttagccattattaatttcttttgataagaacatttaaaataactgtcatttccaactgttcttttaaagaagaatcatatttttaaaactagccttttaacttaaaaatctaatgatccaaacattttcacatttgtgacataacacaaagctccttaaccccctctcctcttaccgtaggaaagaaaatgcaaatgccttgaaaggagtatttatatcatcttattattctttctctgcatgaggcaatttaatttcatttattaaaaatttttattctgaaatatttcaaatatggagaacaaaattgaaaacaaaatttaaaacacttatgtagccaccatccagtaaaatcaatctcaacattttgccatattttcctcaaaatttttttctatgaacaaaaaagaaatataattgaaatcttcctcccactcatccctgttttcattctattccctcccctagtcctgaagtaaacactaaactgaagttagggaacatacatttaatgctgttgtactctatgtattcattcactaataaatgtagtacaaatttgcaagttttaaaattttaaacaaatgttatcatactgcatgtatcattatataacttgccccttccccttcctctccttccttcctttttcttttctttctttctttctttcgttttgctcttgttgcccaggctgaagtgcaatggcacgatctcggctcactgcaacctctgcctctcaggttcaagcgattctcctgcctcagcctcccgagtacctgagattacaagcacacatcaccatgcttggctaattttgtatttttagtgtcactgcacccagcctgcttctttcatccaacattatgtttttgcaatttatctatgttaatgtaggtgcattaatgcagagtgcattttcatgctgtgaaatatcctattgcataaacataccagaacgtctatcaatgaatatttgtattgtatccttttttgttttgcaattacaaagctttaataaccctaatggcacatatcttcttgtgcctcacccaagcatttccctagggtatacacttaaaggtcatattgctatgtcatagtgaatgtttaatttaaacttgcctacttactgcagaattactctccaaagtggttgtgaaatccacaccagtagagtgagggcaatgcactttctgtgccgtgtagagtattttctgccttgcctgctgagctggtgataatactattcagcggtttttgtgtgccaaaccttggactaagctattcacatgtactatcccacttaatcctagtaatgaccttttaaaccaggccttatcaaacccatttcacagccaggggtaagaggcttggagaagggaagccacttacacagggtcaacctgacagccagtggtgggatggtaatggtaaccagctgtggcagagctcttaaaaaataaatatcattgcctattgccttccaaacgcaaaacagcctttttcattgaccagacacatgagttgaagccataagtaaaataaagttatccaagtgcctaaaaattgggtatacatccctaggctgaacccagagcctgcctccttcctcccaacttgtggctagtgcaaacatcagggtcgtttcctggttggatttccccaagaaaccagctgaaggctcccagctgggtggcatcaagggcaggcatgctggctttcagagcccagaagtaatgatgttcacagtccccaacccctccttccagccccaacccctccttccaaccagggcctccccactgtcaatcagggtgatgtggagtgcatcagttacacgagccatttggagcatttttccaagagaaggaacaacatcataaagcgtcggcaactgaatcagaacaaagggatcctaaagacaactttccacttaggccccggtaagccgaaggaatgttaaaaagacacacgaaccttagaagtgaaagcagagagtgagagggaaatccccctcggcctgatgaatcaattccagaaaaaccctctcacctgtgccccatccatcagcaccacagtcagaagatgggaaacattggctctcactcttagcacctctgtgttagttacctaacctctgagtgtgatcgaagaaaactgatcccgagacagagaccagaaaaccctgactcaggattacagcacatcacaaaagtggggctcccccttccttcccacaaagggatccagagatgctgataagatggcgcttgactggatctgggctccaatgcttcagtttttagtttgagttcaagttcacaccagctacagcaatcctgcacactggctacaccagcctgcctcgagtgtgtgggaacactcgaggaaggccgataatcatggcttggggcatttcggaggaccattttgggggtaaccatattccaatacagagggagggtagggcaagcattaaacacaggctttggagtcagccggacctgagtttgaattcacttattagctgtgtaacgtgggcaagtgactaacttgagactcagtttccttggctatagaggaggtaaggctggatgcagtggctcacacctgtcatcctagcgctttgggaggccaaggcaggaggattgcttgagccaggagtttgagaccagcctgggcaacacagtgaaacccagtcactaccaaaaaaaaaaaaaaaaaaagagagagagagaaggaggtaaaatcatcaacttcagctggctattctaaggattttaaaaaccatgtgcttagagcactcagcccagtggttggtgcgcaaacgagcagcttactgtgatggtgactctgtgagaattggaaaaaggcacccttcttcaagacacgtgacggtcatttggcagaaataattccgcacatctaccatgactacacggggaatgttgcctgctggagctgtgcagtggacaacttgcataaccatgagtactggccttgcacatagtaaatactcaataaatggtaactgatattctattagtaaggataaaaaccaccaccacctgaggcctccatgaggagtccttggggtggcactggattcctgaaggagcttatacgtgaattcccagcctccaggaaaagcagaactcgtggacagaggcatgggaggggcagtgaggggagggcaggaagagttgtcaggcaaaagtcccagcaggagacagggctcatgattctcaggtcaagcccaagaggcaagcctcattagtcaggggcaaggtgaagttctgacttccaccaggaaggcatttggagctcagctgacctcccagggctgcactgaggagcacatgggggcaaaaatgtgtgtgaaagagaaggccctgtgcagcacactgaaggattattactgcctttcactccccagtgtcccatccatgaaaaccttctcctccctgcagccttcaaaagtctcacattctcaaaaaaaaccttttaaaaaatcatgtatattcttttataaaaaactaattataaaaataagacaatacatttttttgaaggtggcaacgtcactcaaaaaaataaaccaaggatacaagtgggcaattgtaggataacgatggccaatgaacaaatgaaaataagcgaaatctaagtgaagtaaaaagtaaaaagcgtgagatcgtgccctgtgtggcacattgggaaaaacataaagactgatgatatccaaatttggcgaggttatagggaaacaggagctctctcatcccgttggtgggtgcataaggtgctttcaaacatcatagaaacaaatttggaagtcttcattaacatctaaaaagagcacatcctctgactcagaagttgtccttctgggaattgattctgcagaaataaaagcaccagaatgtacagtgaaacataaatgatgttcactgcagccttcttaaaaaatactggaatcaacctaatgcccatcaaaaggacataactgaataaatatgatttttccatagaatggatgctgcattagagaccagaggtaaaactacacgaactgacctgaaaggaggaacttgatacagtatcaagccaactgcaatgatccaacaatgaaaattgcccaccacaattctgtaaaaattgcatatgcacttatgcatgtaaatgtggatgtgtgttttaaactcaggaaaacattgggaaagacatataccaaattgtccacaatggtagcatctggtgttgtaatcaaactgccaagacaggttgtggaggacattaatgtcctcttttatagctctataacatttttttttctttgagacagagtcttgctctcttgcccaggctggagtgcaatggtgctatctcagctcactgctgcctctgcctcccgggttcaagcgattctcatgcctcagcttcctgagtagctgggattatatgcacccgccaccacgtccagctaatttttgtatttttagtagagatggggtttcaccacgttggccaggctggtctcgaactcctgacctcgtggtccacccaccttggcctcccaaagtgctaggattacaggtgtgagccaccgtgcccagccatatctccataactttaaggggtagaattatggttgattttcacttgtgtcttttagctttttttttttttttaaacaaattttgaaagcatatgcttgttgtagagcagctgggaaatcgtgagaagtgtttttctcatttttgtcttttgtctcttctcttaggattgccttctgtcacgtaaaacctcatgtctccacctttgtgggacccagcactgtgactgggaagtgaagtctggggtacagcaagcatagagaatccttggacattatgggtggaatggaacccctcaactagtttaaatgaatgaaaactgagtcacacattttgttttccacatgcggacactgagacccagggcgaaggcagggcttggaagatgttgttattcaagcaggccaggagctatttacgaggagaatgacccctcagaagtttgtgtgcgtgtgtgtgtgtgtgtgtgtgtgtgtgcgcgcgcgtgtggttttgaccaaagcagcagctgaccaaggccaaaaccaaacatccgcaatgaggaaaaataagcacaagtcttgagtgggtcccgggggtctccccagccaggttcactgccaatcactgaactccttttctttgccatcaggcaccccatccccattattcttgtccttcttctatcctgtgaggtacattctatttttcccatttcaccaatgaggaaaatgaggctcagagtaggtaaccccgttggggaaggtcacacagcatatacatagcagaggcaattctgaatccagttatgtatgtttaatgctgacacatagcttctgaagaaaagctacttccctgtctctaaggcctttttctagagcatttgtagaaaagagtagtgcttgaaaagatgccaaggaatggctggtgaggattctggggctgtttcagtgtgtaggcaggggaggaacttaggattctacgtgactaggaagggtgactgggccagactcagccttccttgagcctctggttgctcatgaacgaatccggcttcctcaaagtctgcctccagagcaataacaaaagcagctcttgctaactcagtggctggggccgctgtgggcatatccccgtatctgggcacaagctttgctcattcattccatttttctcatctgttgaaaagtacctgatcggtaagcttctgttttgaaaataaacacccttttggattccaccctttctaggccaatcccttcagcctttactgatgcttgtatctctcccctctgccctctccttctgggaaggtatttttctttcattcttttgggatttggctgacaatcgatttctccatgctggtagagtcatggggaaaggcaaagacctcattcaggaggggatggaagggaggagagggtagaaaaaggtgagaaggaggctctgcttctttatctggaacctgtttttcatctctctttgtcttgccaggtcctcagcttcttgtctacaatgacgaagtgtatttttttcaacagctggaatgagaaatgactaaatcatcttggatccttggatcagattactgaagggaaaggagctcatttatctaaaagccaaaccaaatacgtgtagacacctacgtagttaaatcacagcagctctaggtagttaaaacagcagaaagcccccacgcagatctgctgaaagtatctcccttcacctacccacctttggtagctgatattctattcttagagagtcatttgcttaactactgtacccgttaaaatgcacataggtataacagtgctttacatttgcataggatgacagggtgcttgaaatttttttcctatgtccttctattcactcattcaaataaattctatgagcacctattgtgtgccagaactgagcaatatgctggtgctacaatggcaagcaagaaagatatgccatgttgtgctgtgagagcacaatgataggttaactaactagacttgggactacacgctaggcccttgactcctgatccagcgctgctttcatccaactacctgtcacactaatgttagggtgggagaagacactgtgttttagcatcatccttgccttggtgcaaatcagtccactggttcatttctatgtgataaccatctgagagcagggatgaacatggagatggagagggaggtcccatgggggtgtgggagcactgaagggtcatccatgggattccagggtgcataagggagatcctaggaggaggacccaggatgaaaataggatgaaacaatgtacacacaccttctttccttcatggtgtcccttagcaagtattttaatcatctctggctgacttcctctccaatttcagatggtacttcttgttaaactctctcccaagctccttatgtcttcaaaacatctctcactttcattagagatctcactttcccttaagagaaagtcaagtccatttagcatgtgcctcactgatgacacctttcctcccctagtaatatccctgtctccccacttttccacttggtggtggggcaggtacttttatgggccaatgaattcctccttatacttctcccatttcctccagggccaaatatctgaatcctcttgcttttgtatctgaagactcaacctcttctggctccctcctcttggtccacaaagaggccccattctcccctgtctaaaaactctttctactctggagccacctctttctcattcctccatgtctgtggccttcaccccttcttctctcaagtattcctcgactctccatcttttaccatcacagtgatactgtgtcagatgccagcattgacccttcagtgccagaagttacggtcctgcccagccttcttcatcctcaccctcactttcatgctcaaagcagtgaccttcctcctgtgcctggaactgtctccctcttttacttctgtgacacaacactcagatttttccccacccttgctgttggcaccttttttcctcctgtattgtcttctttgagttccttacttatatatgcaaatgactacagaaagaagagttggtaaagagatggcagatacatgttcaaggaaagacagaagaacatcaaagtgtgcggtgtcctaaagtatctttaggatggagatagatggcaacaggattacatgactcagaataacactgtttaactttttagaagacaaatctaggcctgaaaacacaattgcctgaatgaactgggcttttgtggtttgctgcctataacagaattttgctaagaaagaatctcctagtggctgaaagtgcccaaatagaaactgggagattatagagcaggtagttttattgttattattattattattatttgagatggagtcttgatctgtcacccaggatggagtatagtggcgcgattttgactcactgcaacctccgcaccctgggttcatgtgattctcctgtctcagcctcccaagtagctgggactacaggcattgtgccaccacacatggttaattttttgcatttttagtagagatggggttttaccattttggccgagctggtctcaaactccttacctcaggcgttccactgaccttggcctcctaaagtgctaggattacaggcatgagccactgcgcctggccagtcaggtagttacagataactctgcttcttcttgagttctttgattacatgataacctttctcagtctttttcaaaaccccaactgtcaccaccaccagcattatcctcatcaccatcaccatcaacactcttaccactaccctccccccaccataatcatcctcatcttcaccaccataattcccaccactaccttcatcatcactgtcaaatgccattgaatggtcccctactaagaaccaggttctgtgctgagcccttcatatatattctctctcttcatgttcatatcaactctgaaaagtcagtttataatttcagttttatagatgagaaaaccaaaactcagaaaggttcattaacttgcttagaaggacccagcagtttaaaatgtgttccctactaatatacacaagagagtttattaatccaaaatcaagatatctgtttaaatgtcaaccaaaagattgaggtaaaaaagacattgatatgacttgcttatctttaacaggagacactgaaactaaatagtggtttaatagcttctcctcagcattctgtctcctaatggactttgcaggactattttaggttgaaatttttcctgtccagtaccaaagctcttcaaagattctattcccatcccttacccttttgggagacggtcagggagagagagggaggtgtaaaatccctcttacaaatccttttccaaaaatctttggctgaacaaagactttcccatttaagagcaggtgacagaaagatttctcccataggcagcgcattaaggctctctgcagaagtaaacaaatctgttatgatgaaagccggacattcctcagagccaggatctaatgaaaatgtcagtgttttatgcagtttaaaaactgacaattcaacagttttacaggagctatttaatgtttatcatcacttacaagggctcaaatgcagacaaagggaagggcaactaaagaaaccaagtggatctttgcttggaagccgccatgttatctataaaccatgagagtatggcagtttataaattaccaggcagcctcaggcaataaagtgtaggtcttagcaaatgaaagttggaaatccacactccaagatacaatcatcatagtgaccatgctctgcactttcatttacacctcaccccattaaagacccaaccactggggagtgaggatactagagaaagcccttaaactaacctaaggtgatccattaaaagcttctgagttcttgccaaattgtgctttagatactatcaaaaccactaagaacagagaaatagaatatgtaactcccaaaccagtagggggaaaatagaaataaagaaagcacagtcaattcaaataggacattaaaggagaggaggggaaaaaaggagaagggaacaaaagaaccataataagagaacatgcgaaataagaagagtaggtccaaatagattagttacaataaatacaaatagcttaaattcacccattaaaagacagagatgctgggtgtgattgctcacatctataatcccagcactttgggaagcagaggcaggaggattgcttgagcccaggagttcaagaccagcctgggcaacatagtgagaccccatctctacagaaaacaaaattagcttggcatggtgacatatgcctgtggtcccagcaacttgggaggctgaggttagaggatcacttgagcccaggagttcaaggttacagcgagctgtgattatgccatgcactccagccagggttattgagcaagatcctgtctctgaaaataaaataaagtcagtaaaaaaattaaatctagttttatgttgcttttaaaatggaaaatggaccagtgacacacaaaggctaaaaataaaaggttggaagaaatatgcacttgcacacaggaacagaaatgtaaaggcaagagcattagtacagatgaagaagattattaatgaaagataagaacaacctaccaggagctataacattagatgatgacattttatacaattaaaagtatatcctagatagagagaaaacaaaaaatgactgaatccataatgattatgaggattttaatgcttatctctcagaaactgagcagttaccagctaaaacattaatagagatttagaagatttattagataacttataagcttcatctaaagaatatacaaagaacatgcacccaaagagagaattctcttcaagtacatatgaaatatttataaaaaaattgaacatgtgcttggttacttagaaatctgaataaaatacaagaagcattattatgtacttgatatctgcacttctgtgttaaaagaagaatgatttggccgggcgcggtggctcacgcctgtaatcccagcactttgggaggccgaggtgggcggatcacgaggtcaggagatcgagaccatcctgactaacatggtgaaaccccatctctacaaaaaatacaaaaaattagccgggtgtggtggcaggtgcctatagttccagccacttgagaggctgaggcaggagaacggcatgaacccaggaggtggagcttgcagtgagcccagaccgcgccactgcactccagcctgggtgacagagtgagactccaactcaaaaaaaaaaaaaaaatgattttagaaccttacacatcaaggccaatccacccagtttccacccagcctagaaaatagtcctcattttctgaggcttgtcttggtgttacctcctcagaaaaatcttctcgggtcaccttaagtccggtagttcttctcattcccagtgactccttaataactctactgtacttttcttcatgcaacttactagtttctgaagtcatcctatttgttactagttcactgccttcctggccccaccctttgaaatataatgtatttgcaacatctagctcctggaatggagcctggaacagagtaggcatcaatgaacatgtgctgatgaaagcctgacttggcaccctacagtgaccctagcccttcatagagatatagaccttgcccctagaatagatcacattacatcaggattacttgtgttacaatctcagtaagagttagtgagtttgtcatcatatccacttacataatagacggtaaataaatgactaaactatgtccttccccatgcaccaaaagaagccacaccttgggaagccacatcgcctgcttacagccacatcttgctaacgacagagcctgatttctgactgcgagcattactctgctcctccacatggcctccatgtcccctgcaacacaacctattatgcgtggaggctgcaaggacagagaagacaacttgcaaatgtctttttcagcaaattcagtgtttctgttactattatatagatactagcttttgccaaatctattaaaattgactcaaattatcatttcttataataactgcatgtctgcataaggactgcattgtccaattaaagaaacaaagaaaataatagttcattgactcaaaatcagctgtgtggccatattatcagcccaatagttaaagaaggaggaatcactgtgtgaccttggacaagttgcttaatggctgaattctcaagtttccacatccatgaaatgctcataacattagtgctgactatgcaggctgctatgaagactaattagattactccattaaagcactgaacatagtacatgtgtcccaatgagctcgataaatgtcactagcatttcagacacctgcatagtcaacttgattcttttgcactgctttgcaagctttgctcgagaaactggtttttgatcacctgccttccatagcccttccagagatgcaccactgttatggaatgaatcttaatgttcctttgaatctgattaaatccattcctccctgttacagtggacctagaaaaatcctggccaatgccagatgtatttgttggatggcctttttaccgaagatttcaggaagatggggctgctgtaggggcagtcaagatcacagcattgattaacaaaggggcagattgtctggggaacattcttctttgacctaacccttcttcctcagaaggagctatgctagaatagaaagtttccaccacagacatctgcttgccagatctgtcccaacactgtagccactggtgagagccatcaggcagtacagattttcccttggattggcagctacttgaagaagggcacaagtaggcttcaaatttatcatggaagacaggagcagtacaattttggcaaggactcccttcaaacatcaaaaacttttgcagactcctccacctaagtgtaattttatttctcttcaaataaatggctgttgaataaatgactaataactataacctcccctgtgtgccagaagaagcctgacaccttgggaagccacgttgcctgcttacagccacatcttgctatggactgagcctgattcctgactgtaagcactactctgctcctccacgtcccctgcaacacatcctatgaagcatggagactgcaaaggaagacagagaagacaacttgatacctgatgatcgacagctactaggaattcagtaatgttctgaaatgctaatgtatttaaattaagtaatgtttttaaattttagaactcataatagtgtctatgcacacaccagagaaattatcacacatgtatttatgaggcattctattctggatcatggttcattatgtgtgtgtgtttgtgtttttgcagatttgaggactcccaaaggtccttagtccacagataaggagataagtcatggaaaatgtagaacttgttccttttaaactggagtttttaaacttcagcactaaatcaatagtgctatgctatagaaaaggaagagtgactacagtcatctatagtaagaaattctcagttggaatattcatgctcaatatgtgtaacattttgatcaggttgaagataatgacaattttttctaccaaattatttattttcacctcaaggttgatctttaaaattgagtcttgtggatgaataacgccttggactggtagaagatccaagttctactttcattttcaccaggaactaacaacataacctttgacaaatcatatcgctctctgggcctcagtttcctatcagtgaaaaagctcatgtgaggcaccgaggcagaagactatagacaggacagaaaatggaagggaattgaccacccagcaaaaatgcagtaatggaatcaaagccagcattagaagtagcaaggagctgaatcactgctctagaaaatatcatcagaaaaataggctgtaatcttgtgaagttatcccagaatatagagatgtaatctgtaagggacaacatgatagatatgggaattacatagtgagaacctgaggataatagatgctctagaaaaaaagaccaaaaactaagaaagggagcaataaattaatgcaatgaaacacatatatggcaggttaaaagggcttaccagaaaaatgtaaaagaggtaagcagtagaaataatctggcacaattgttgacttgttgatgtaaagaaaaaacaatctataaggatctggaaagaaaataacaggctgtctttaagagcacacatcaagatgggcctcaagaagtacccacccatagaagtacctctctgtcatcgtgcagaagatgggggaaacattcacgtctgccatcttctccccaccactcaagtcccattttttgttgatttatttggattttcagatcaagacattatttctggtttttgcattatacccctttgaaaagcctcttttgacatgtgtgctcttcactgattccagtatatgacagtggcttgtgatgctcaacaccaattcaggaagaggaatagaagcctagaagagtgctgttgggggcagaacacttgtcccagagagcaggggagctctgcacaagcttcagtgcaggcctttggaagttgtctgtgtggacacggcctctgcgcctcacctagagccattaagtcagaatccctaatgcagtgcctgggcaagtacccacgtggttcttattggcagcctgggtgatgagctgctgatgtcgctcctactggccctgccatgtggcatctggatgaggagctggggaggcaaatctgggcatcattaatacctgctgctggccatggcaagctcgccacaggccctcttctgcagtgccaaagcaggttcgcacaccatgcggacgggggctgggggtaacacaaacgaaggaagtgaggcagatgtgaggaaggccacattggtgaccagtaaactggagagggctggctggacaaaggagattgctggggcaatctcgtgggaatatagctcgctataaccagatcatctgtttttttccaaaaacccagaaagccagaatcgtatattatattttccggtttttggaacactctgagccaaacaaaatgccatctaggcagaactggcttataagctccatatgtgactccaggcttaaattcttcatgtccacagaaattgcccttttattttaatcaaaaaagtcctcctcagaaacaggtcaggcctttctcagcaagtagaaacctaggtgctccaaatgactatcttcattaatttgttaattgtttaaaaagctactcagactgccctgaagttcagctgctccctgtcatttcacattcacactggttgtgtgcaaacaaccagcgagctgtccttcggcactgtaaaatgccacgagtccaggaaacaagtgcttcctgcctatgggagagctctgcccctctgaagagaagcagacacattcagagctggtagcctggactatcactcctaaataagagaaggataaagagccggggagccgggtgcggtggtttatgtctgtaagcactttgggaggctgaggcaagagaatcccttgaacacaggaggtcgaggctgcagtgagccatgttcacaccactgcactctagactgggctacacagtgagtcagatcctatctcaaacaacaaacaaacaaatattcgggcctctggaaaagtccatcggacaggaacacaaagggatccagatgccagagtaagtactccacttcctttttaataaccagcatccactgggaacttcccatgagccgggctttgtgttttggctgcacagtgaaacagtaagtcctcaataactatttctgaatgggtggatggataaatgaatgaatcaggtatctcttctatttcacattcctgaaattgaaccttagcattgtgagggcacttagatttgcaaaatctcttccttcctttgtcaacaattttcaagagccagatctgtgcaaagtcagtgtgtgagagactgagaaaacaacaaagaatctgccgtcaaactgcgtcctggacagaaggacatgtgagacctgtgaaagatgcctctggatccagagggcagtgagagaaggcagttctctgggaagattcctgaagatgctcacaacccttccctaaaagccatacaaatccctccatggaatagtgaatgtccactgcaggcagctttgctctcaaggaggagaccagcagaggctgccctgaaaaggaggtatctcagacagaggcaccataagagttggaggaaccaggaaaacaaccaaaaacaggtaccacggtgctgatgtcatgctaggacagtgcatctactattagtggacacttggaaatctcagtctctgcaggagaagcgctctgccgctggggttcactctgtggcagtgttgctcaggaggttctctgctgtgtagcctctgtgggcagaaccctagctattgtgggacatgatgccagctccccggggacattttcccttgccccccttcccatgctaccacaacctaacacaacctaacacctaagccatcagatgttcattcacccccccaatgaacgcctgatcatctttcatttcatggtcttaacctcatgtctctccttgccagctccagagaggacttgtttacctcttctatgctgtgctagtttctgtactcatccttcagagtgtgtttcaaagtgtgaaaatgtagctatttgctaaatcctgcccagcctctggctgtgggttctcagagggtgggacagggcatgcctgtcttgtccctactcacaagagaagaccgagcatctccttaacaataagaagggctccctcatatatccacagagcttaaggtagtaaggatattcttactcctcatgctgggatatctttaccaggtaaggagaagctgggagaccttaagaagcatttcccccttccctacctccatgacttctctgttctacagatctcaaatgaaaggcttcctaatgagcaaataatgtctaaaaccagagatactatgtttataaaataatagcctgttattgtgaaacttagagctagagatagtcaaaacaaaaataagacaaaaagtccaaaaaccattgcccttgttcttggatccagaagtcctaaatttttaagaagccgcagccgggtgcggtggctcacgcctgtaatcccagcactttgggaggccgaggcaggcggatcacaaggtcaggagattgagaccatcctggctaacatggtgaaaacccatctgtactaaaaatacaaaaaattagccaggcgtggtggtggacgcctgtagtcccagctactcgggaggctgaggcaggagaactgcgtgaaccccatcttactgcaagcaggtggagcttgcagtgagctgagatagtgccactgcactccagcctgggtgacggagtgagactctgtctcaaaaaaaaaaaaaaaaaaagccctttgcctcaaatccaattcattttttgaaacaaatcatatttgaaatgtgtgtttctccctgtctcattatgaagaaaatcctgagatacagtattttcacattccataaaaatctgaacagctgctttatacacaaatcacacggtatacatgatatcccaaagatcaaaactggcattcatagataatcttttaaaaagacaaaatccaatgaatatggtcaccatcctttctaaaacttgaataaagacagtaaaaataattcactgactccatcaatattcttgtgcaaaacagatgatttcaccccccccagcatgtctctccggccacgtttattcagttcccactgtgcctgccaggctgactctcagagagagaaagcaatgaaaatatattacactaagatgaaactaaacgactttaatatttccttaatgattcaacaaatcctttcagactttgctagcattgtgagggcatttggatttgcagaatctcttctttcatttgtccacgatttttgagggccagatctgtgtgaagtcagtgtgtgagggatgaagaaaacaaccgagaccctcccctcaaactgtgtcctaggcagaaggacacctgagacgtgtgaaaggcttaaaggtgaggccattaatattgattatgctattaatatattacacatctatatatataaatatcaataatattaaccagtggagagagtagcttaggaatattttataatgtgaaaaaaatacttcagtgtccaagtctcttatttaacctttacaattctctctaccctacttcccttttctctatgttcctgctgacactacactcagcaggcatgtctgaggatgagaaagaaggccagtgcagcatggcacggcactgggggagggagagaacagcaacagatgaggttgggaaggtagtcaggggacagagcatgccaggccttgtaggcttgagctaagcatttacgtttattacaagtacaaaggggactgcctggagggatttaagaagggagtgtatgatgtaatctacattttgtaaagatcactctgccaacttgcctgatgaatttatgccttatgcccttgatcagatcacaaggagctggatggtagggccatacgtagttactctccctttaatacccccacatcatggactggtagaatgttaaaccagtggctctcaaactttcctgtgtatcaggatcatccagaggcccatttaaacacatcttgttggactccatctacagagattctgattcggtaggtctgggcaaaacctgagaatttacattactaagaagtccccaggtgatgcgaggatgccagtggctcttcaaggcactgcacttagagaacctgtttaaatctgtttgcagaataaatcaatcagtgaagaaacatgcaaatttttttttttttttagttggttatttgtttttgagacggtctcactctgtcgcccatgctgggctgcagtggcatgatcatggctcagtgcagccttgaacttctgggctcaagggatcctacagactcagcctcctaattagctggaactacaggcatgcaccaccatgcctagccaattattttattcttttgttgcccaggctggtctccaactcctggcctcaagtgatcctcccacctcagcctccccagtcactgggattacagacatcagccaccatgactggtgaaaatatttttaaaacaaacaacagaaataatcagtggtttgaattttatgtaaaatacaatcattcattctttttctttttaagaattattcttttcaatctataatgtgatgataacaaaaggactaatcattgcatacggaagtactctgaaaggaaatagatcattgtgattaggcaagatgagacacttcagaggctgtactgccaagtttaattataaaattaagtgtcattcaaagaaatttttattgcaaaagtatgtgatttacttctgtaggcagttattacaatactgcctcaatccagaaggaatatgagatggtgaggcatctcttggttcaattccaaaactgaaaattaaactacaatttccttagaactcaggaataaaactcatcatggctcattctgtttggttcaaagtgtacaacattgatgaacatatctactgtaaaagcaagtagattcaaactctcttcctaggaggaacccccaaagattccaacttaggtacttattatgccaaagcaaaaatgcaactcaagaatgcagagtaaatacagactcagagccaacagatgagaataaaagtcagacccaggagagttgagtacagacggttgcacaagaagcataaggccaatgccctatggtctctgtgggtttattcttttctgccacatgtgaggcttcggtttccatgtaccaatgtccatctactcagaaatcatgattgcaggccaatcaacaacagatagtccaaactccgtgatggcttggggtttaggggttcagtaggaagctctctggcctgaagcctgaaaagtcacaggttcatattctgcttagggaaggagctggttaggtatatccaaaatcatatagggctagtgaaatctcatctattcattcagtagttactctggatctcatggtctaagaagtcaactgggctgggctagggggtagaggaagattcaaaacatcaaaagccacaaaatcaaaacaagaaaaagtgttgaaaatcataggccttggaaagcaaatagtaaatgtaatagtcattaagtagcaaccaatgaccaaccttcctctctgtccatgtagcaagatccaaacaacactgtgtggccaccatgaggctgacacaacaatttacatcatgtggatgatggacctagattattgttctacactggtgggaatcatggaacagtctggctgtgaattaaatacaaaaatagcaactcctacactctagcaaaatgtaaagtacatgtgagcccccaaatccaagctcattatgcagagtctctctgaaacccagcacccagcatttgccgttacccacctccaaaagggtaaaagtaaacattggacctgctctggtgttaaactgccaccggatcctccccgctgtctccctcctcctcttcttctttacagacaggtaatgttggatctcgaaggaactgggggctcccactctaggcaaaggttggacaggtgatcaatgtacagcatgagatttggctgtgcctacgtgcctccgacagagctggatcatctgggacaatgaaaattatgaaaattataagcaacaagaaagcagtattaacagcaagggcagggaaaccaggacagcacataccacagttcctaggacacccagcaaccattcctctcctcattcagtcattctacacacattcattaagcatggtgccaggctctggagatatcgtagtgacaaataggaacacagaccctgcccccatggagcttatggggtatgtgggagaaagaccagacaggcagttacaggacagcgggtaaggaaacctagagggtgccatggagcacaaagcaaaggcagccaacccagactgggggtgagtggtcagggaaggcttcctgggaagaagtgacatgtaacgctgagcctggagaacccatggagttagccagccaagactggggtgggtcagcacgtgcgagattcctgagaatctttggctggtccgaagggctgaaagtcctttgttctcagccattctgcagcctgtaatcctacatccaaccagagcacccagatttggagtctgcagccctgattacaggaggaactggtgctcctccaatgcccacaatccagttgcattttgacttctgccagtgggatctcaggaaactaaagaacttagaaaatagtgtgttttttttttttttttctataagaagagagaaaaaaaaaacaataatgcagagttgaactgctacggaatagacccaattgcagcaatcctttctgcacaccagcatcggggtaagggagatgccatcctcatggagactgttgaaacagacaagaaggtggatcacagtttggtatcacaatacgggagcccactttgccccttcctttcctccaagtccctgagaaattgcagagggagcgctttgttcttcttacccttggtgttgacgtctaaaaggctatcgcagacatgatacctcccacttgcctgatgcaactaggggaaaccagatagcttatgaagccaatcttgtcaggagcctccatgtgggggaaaaaaaaacaaaacaaaaaaccccctaaaggctgggaaagtcccagcagcttgaatattgcccaggactctagctacctttgcattacgaaagagaccactggagaggatggcttaagactgggtagtaagcatgtggtcatttgaccaaagacacgtagtccaaagtagctttctgttttaatattatcatatgatccaagtcctacaaacaacatccttgactgaaatcgaaaagaaacaaaaccctcacttctaagaagcagagcaagcggcgtttttagagacaaagaaaggatagcttcttaacctatgacaacacaaatttgtttaggttttccctccaccaagtaagtaagcaattaggttttttacaataaaaatatccccgtgcatgtgcaaacaccagaggcaatcatataattaccctgcccaatcagattcaattgctgacagttgagttcccactgctcattaacttcagatcacaaagaggtctttaaggaagccctttccttctctttacaaaggttcctatgatgccgcgatcagccccggcactacctcatgcaagataatcatccccaaatcaccagggccaaggccagcctcctctggcttccttctgaaaaaataaaatgagaaattcgaagacaccttggcttaaacacccttgcttcatttggggatctcacttctaaatataatagtaacctttcacccccacattttaagtgccgtaattacataattaaaaccaattatgtcatttaacagagactttgtcaagatacggcaagccaattacctcaatcattgacctcagaggatttcccacactgacctgaaacagtgagaattgggataaatttagacactggcttccgaaggctggcatggactagcagggtgggttgtaactggtctagattctttgagactttagaagctaaactgaattcattcccatctacaccatcactacttgtttgcacaatccttcccatatcccaagataattgcttgatttttttataaccactctgatggaacgattacttccatgttgcagacagaaaaaggaggcagggagagtcctaaagttatctgaagtcaagcagctagtgttaacagcaacgctagggcaagacctaagtcttccaccacagaattcaaagtctccatgtagcgagtggtgtgtgggtgcctctcttaccccaatttccctttgaggcaacacatttgcccccacttttatttaattcacctgcacggcacaaggttccactgcaactcagggggtgtgtcctaaattaggccccagccaattagcttccagcattcctcccctagccacagcattggttcaggatgagcacatgatcccatcaaagccaatgagagacactgacactttttgcagggcctgtgcgatctctgcctaactgtgcttggagtgaccggagggaagactggaagttaagcagccatcatgctccactgaggaagtgagggtgactggagccaagagatgtggagggagaaactggttccaggaaacaccctctattccctgtcgcttcatgctgcgagttacaggggttattcaaaagcacactggagaaagcaggaagagcgccacctacagcttgggtaggctccatttcgaggatggaatcaatccactgtggctccgaggcctgcctcctgcttgcgacagttaaatgccttcggtttttgagttatttaaagaacataccattttatgggcaggaggaagcactttaatctgcaaaatgatttttatcacaaactaaacatccttgtaactttttggtcctctgctttggtcaaagttgtctctccttggagctcagacagctgttggagctcagaagatctgcctccaccctgcactttgccctgctcgctggtactctggtgctctccaattcctggatccatgtgggatgtaagaactcaggatcaggacgcctgcacgcatcaaaatggggcattttctttctctttatcccaggacttgagagaaagcaaaaaacaaacaaacacaaacaaaaaaaaaaaaaaaaaaaacaagaattcctctaatttaaggtttttaaccttgacacttgaagttttgggccagacaattatttgtcatcaggactgctttgtgcaatgtaggatattcctggcctctacccactagatgacccattagcacccctcatttgggacaaccaaaaatgtccgtggacattgacaaataaccagggatgggggccaagatcccccctcattccccagctccccatttcctggttaaaaaccactgctgacagcatctttaaaaacataattccttgtagtattatgttgtgagactgagagaaccaccaccctccttagaactttacaaaagccatataaaatatcccctgaggagaactgacttaaagaaacttcaagatagcagcctgcgcaacatagtgaaatcccatctctacggaaaaacacacacacacacacacacacacacacacacacacacacacaaagtagccaggcatggtggcacgaacctgtagtaccaactatccggaaggctgaggctgaggtgggaggattccttgagcctcggaggtcaaggctgcagtgagccctgatggtgccactgcactccagcttggccgacagaacgagaccttgactccaaaatagcaatactactgtctgtcagggctatgaagccacatgagacttgacccattaaggacaagagtgaagaaaaatgtatcaaatagaaataattttatctaaacactggcaagaggaaaaagacatggaggagaaacttagaaatgaaaagcagtgaggcatctatatggtgagttccagcatgggtgctcagcttctcactttcacaagtaagaaaatggaactttaaggttattgctgggtttccgggattcaaaacccaaagctaaaaatgtggaagaggttggtgttatcagaaatgatctttccagtaaacgcctaaaactcactcactctgcagaaaaagccaaaaatggtaaagcttcacttatttggacaaatgtgggagaagtcatttaaaataagcaaaattgatggatttatagaatatttttcaagggaaggcatttacttgctttcaaatgccagcagtaattaagagtgagctggcagaggtccctccttcaggattggtttgaatgagaagacagaatttattgaactaatttaagcattgttaggctgggaaggagggctttgagttagattgtcctctccgtgagctaattagttgtatctacacacaggcagctggctgagaccagcccaggaattccagaatagtggggttccaatgaggctttgcttccaggcacagacatctgtgcaccttgaggtattgatcaagtcagtcaggagaagcaggctggcttgtgtgtgaaggctgggctgtttgggggcctcactgtgtgaaaagatttggattctagcagtttctttctctacaagatctaatgtctggagagatggagaggcctattaggggagttcagatgactggagctgggacatcactgcttcttcaggtcccaggcagcctcccctccagctatcagcatgtctcggctatcccatgctgtcccctcaatctccaactgccctcctttctctccatcaccagagaaatgtgactgcctagggagcaaccatgtcttgaaaggagaaagagcaagaataaaggtgtctctgaggggccttgcttctcttcccctagttcttttaggcattttgttttgtttcatttggataagagctaacatttagaacaataatagaaaatagaagtacttgtctggagggtctagcagaggtccacagtgactcttatgagctgtataaaggactgtcccttctggagtctagtaatcaaatctggaggagtagtcctcaaatcttgttagagaatgaagttctcagggtacactcttcctggctaagcaatcccatcccagcccctctctactgaaatcattcatcctggtcaagtgtgtttctcagaatacctgggtatgtcaacagagataaaagagaagtgcagcacacttcctagtttcagctggcactaaaacaagagaatgagttgtgcgttttttggtggaggtgcctcctgatcgagtctacacactggcttgtgaacatgttgtctgtactgaagaacttatcccaaaaaggtggctccacttacaccatagacaagtactgtccttcccatgtcctttcagcatgaactgagagaggggcagtctcaaagtggcaggtgtcacaagaggtcactctcataatcaacaactgaagacttcccaaaacagcaactccttgcttttgccccaggtaagccttattcccagcatcaagaaaaggattttaatggtgtgtggactcctggttcaggtagaagttggtatccagagatgtcattccttatttatcaagtacttattcagcaggtccagaaatgttatgcaaaatttggtgttcatgcttatatactttattctgaggagcagaattatggtaaccatattcttaaagtagtttgaagctcagaattaaaaattaagcaacagttggcataaagcaatcccttaattttttttttaccagtttttccgaggcaaaatttacataccatcaaggtcatccatggtaagtgtaaagttcaacgattttaagtaaacttatagaattgtgcgatcagcaccacaaaccagttttagaatgtatctactatctccaaaagaccctgcaactgttacagtaaacttcccttaatttttgcagcaaatgttctagagttgaaaagaaagctctttctacatctgcaaggctgattcatttttctcccttccaagaactctactaaaaaaattatttgttgcttatctgaaatgcaaatgtaactggatgtcctgtatttgtgaaattccggcaaccctaatccaggaccaaagcagaattaaccaaataaatgaaagtgcatgtctagaaataaatgtacttttctggagcattgtaaataaacatgaattattttcctagttttgaaccatttgagttctaagatggtcagaacctagttccagttagaataccagctgagaactaagctacagagacagcctgaataattcacaacccaattgctgttttacaagcaagcctgggacctcagacactcataggattatatgctacatttcccttgaaaggttaaagtggatgtaattgttaaccttgcagctcacaatcagaactggaaatgtgacttttaggggcacaaattatagggaaatcattcttaacctttttggggggcggtgtcacaaactcctttgggagaatctgataaaagctatggaccttcaccataggaaaatgcgtgtatacacattcacaacattttccaggtaattttcttttaggtgggagaggtttcacagattccatgacattgttcatggaaaattcaagggtgcaagagcctgggcaagttgattaaaaccatcctggattcttatgccttgcttttctcttcctcctgtttgtgtgggaagtgaagaagtcgggataatggcaagggaactgactaactcaagacgtggctgtggccgggcgtggtggctcatgcctataatcccagcattttgggaggccaaggtgggtggatcacctgagggtcaggagttcaagaccagcttggccaacatggtgaaaaccccatctctactaaaaaatacaaaaaatcagctgggtgtggtggtgggcaacgtaatcccagctacttgggaggctgaggcaaggagaattgcttgaactcaggaggcagaggttgcagtaagccaggatcgtgccactacactccagcctgggagacagagtgagacttcctctcaaaaaaaaaaaaaaaaaaaaaaaaaaaaaaagaagacatggctgggctacttttggccatcagtggtaagacctggaggaatctgcccacacttcatagacttctgttcactgttgataaaatgaacagatcagcctgactctgttttcacaagttatatcctacggatctactggaaaggtatctggaaagggctcttttaggatctgaagcactgcacaagattttgtaggaaaaacaaaagttttaaaatcactagactacatggtcctcaaagtcaccaaaatactctgagttttaagccatctgattatctgattctagattctaaagagtggaagccaggtatcagttggggaggatctgggtattctttttctctgagtacaaggaaaaaaggcatttggtagggacaggagagaaagacatcccagccctcactactctccagttctgcaacatttctttcttcctttgagctgttctccttccttcatatgaaaaactgtctacaggtatggtaatggttggtcaaaaactacccatattttttctgataaaattaaaaaaaaatcctttcccaattatatgaattttcctttgggtgacaaagatacccaatgatctattatatcattatatactactatgccaatgatactagtagaccacgtggataaaagacaaatgtgctcactctgagttttatagatggcctctctttagtgccttagaggcccctacaaagtaggctccagtattatcatcctcattttttagaagaaaagactgagcggggaaaaaacgttgagtgacttacacaaattcacccacctagccaacagcaaaatgggatttcaggtcacagagcctatgctcatactatgttgaagagagaaattatatcacttaccactaaaacaaacaaacaaacaggttttattcactcattttctctcaaaaacaacctaccactttaaggaagtgtgttatcacacccaatgataggaaccataaaactattttggatgtttatttgatacttattgatgtttaagcaagcctactatgttcacagttatcaccccaaagaaaaatatattatttagtttttaggttttatcttatctgtccttggtccttgaaacagcaagagaaacacgtacactctgttcttacttgttgtcataggataccagctgcctgctgggaaaagcatactgggaagtactgttctacactttgtattaagagttaaaaaataaaatacccagagcctgtgtaaatcacagacaaagttgacaaatttcatggcttagtcatggttaacatatcagatttcatggcttgacagagattaacaagaaaatcatattagaattacaactattagtagattcttagatatttgatagagaaactccaagctctccaaacgccattgcccactgcacagccctcttgtccttcctcctgtggatagagcctccatgaatccagggagagcaaatgggatcttccattgttggtcacaatcacctcacctcctgactatggcaggagtgagccagtgcctagtgggccccagggaaaggtcttagcatccgcgaaataaagtaaggtttaatatttatagcctaattcataaaactgtaaggagaaaaaaaatacctcatttgtacataacacaggtattttacccaatattacatgcactaaggagaggaatgaatgatcattgttggaactatgatattttcggtgaaaattaagtttccatgtctttacgaggaagcaattcagcagaggccttgttgttaaaagtggcatgcgagcaggaacttcaaaagacctgctgactgcctgccgagccatttggccggagggctctgcatatcctctttcgggtaagaggcagcttacttgtcaactttgcataaaagacagccaatttgtcagccatttgctttaattttgtttctgagtcttccaacgacaaactccatataccttctggtctttaatatcatatatctgactgagggatggaaattcactctagtgtctcaggctggtttccttcccaggccatcctcctgggtcttataggatgtccttaatcagaaccacattactcagctagaggaagtccttgtgcagacgctggcaagacactatggcaaaagagtttcacaacatgaaaggtcagattgagaataaaagctgcagttatctgttgtgttttctttagttgagaaaataaaggcagggtgcctaactcctgaggaaccaagatttggataagtagcagccacttaggaaaggagttccattggccgctgagtacaatggccagttgtggaaatggaaagtccttaaattccaagtattctggacctgagcaaggattttctcattttatacagatacgtttttatatttcagtaacaccctagactggtaaaacaaaaatagctacatcttgtcaaaaaatataattgtcactggactgtgtaaatatacacacatatatatatatacactacatatatgtgtgttagatatacacatatacataatatatattttacatatatgtgttagacaaataaagcacattttaatcgtaaaagctaccagttattgtgcttttttttttttttaagtgccaggcactatgttaagcactttccatgcattatttagtctctcaacaaactagcatggtagggactagctttgtccctattttacaaatagaaaaaacttgagattagagaggaaattcaaggcacacagttagacacagagccagaagtggaacccaggagtgcctgacccccgagcccagcaaattgaaccctagcaattctcacttgttccattaagatgagtgcccaagctgactgtgaaaaacaggggaggaggtgaagtgatgagccatttcacttcactaacacataggtgtgaaggagttaggcgttactccaaccctgtatcttcatcccagggaggcagcctgcaggctttgccgatggaaggcagggtgtgagaaaaggaagaagtgattgcaaaaacccaagacccacctcctttacaaattttgcccaagatcagcctggctggggagactctgagaactcagagggaccagaggacttaatggaaatctgtccctcacccagtttcaaactgatagccttcccttctcatgcaaggggcttgccctagagatttggggcaagaaatatttccagtgcgcctctaccttaactcacaccacaggggcagctaacaattacagaaggaatgaactttttcatcaaatgtccttccataaaaccatttcccaggaaatggaacacagcatgaagcaagccgactgcaattttccaccaacaatgagcatcgtggggcacaggtactatatttaaacaattttcctccagcgttttggcaaggctgtctctcaaggagacttaccaagttgggctgaggtctcattcccctccggccagcaggatcagaatgtttaatatggccctgtctcttcaacacccatgtgtaaaccaccaataaacaagccaggaaagacctgcaggcctaattgccttttaactctgccaagatgataaactcccagagcaaagaaggaaagacttccagggatttaacaagtttatctgcctgccacttgaacattttctgtctgcctacacttcagtgaattcaccaataaaaggataaaagggcccagaatgtcagacccctcaaatgaccaagaagttccacattcaaaacgtatgaccagcaaaaattaaccagttaattgagcttcattttaggtgtttttaagatctggagcaagggaagtggggccacttgactctttctagcactggccatttctcttttattgaccaaggcctagaaatctttacttacaataaagaaaattgttttcacaaggaaactgggataggcaacccattctgaaacctctaaaattttagatagagcattatactgacaggagagaaactatacaaatctcggtggtgggagaaatggagtatatcatatgggcagtcataagattggtgtttacttctgtaaagatatttttcatctctccctgaaccaacttgcaaattaagcatgttggttgtttttgttggtttgtaccctaccacccagaagaaaaatactgagagctctttacctattggagttaaattggaaaagcaaagcaacaccaaacaaagagacttggggtaagtacagagaggtggtgccattcaaggcattaaagcagggtgaatgggcatcacctctgggaggccatttcacaatctttatcaatattaatgtgcaacttcccttttaggaatttattccaaagaaattattggctaagtgaataaaggttaagcccaaaaggctttagggaattctactagggaacattttaaaacatctaaagttcaccattaataactggctaaagaatgcaaaattccatactccgttactataaaaatgattccataggtgtatatttattaatgtggaaagtgtccaacatacaatgttaagttcaaaaagcagattataaaaacatttataatataatcccattctttttaagagtctatatatagtaaaattagaaagatacatagttcaccaaaatgttagtatttctggatggtggattagaggggacttttattttctttggcaaagatttttgaattatttgaaatgtttaatgagaaaaatgcattgcctttagaaatgttaaaacactaaagcagaacaataaaattgaataaaaacaaaacattcccaccaccatcattactgtcctgatcaacaggaaaagctgaaacaacatcatgggaagacccagctatcctttctcgaggaggcaggagtagagaacgctgatggatttggtcttgccttatcagcacatataactgttgttcaagcgtagtctccagtgagatgcgaatggaatggtaaaaccacaagtgggctcaaaatcccaacaggtgtcttctccaggggacccaggtgtctctctttcctggaatcatggtacaaatgtcgaggactcccctattaagctaacctgtaccacttaataaaacaggaacagttcttaagtacggcacttgccaactgaaaaatctggagcactatttttctattaaaaccttgtccatgtttttcctattggaacctggaaactggacaaattctgaagaaatccgaaggaatttctttagaaaagaattctgttaacaccaaaagctcccaagcactacacaaggcaaatgctaggttgcgttacgctcaaatgtaaaagcagggttccaatccaaagtgatgtgtccttcacaccaggctttgtgtgcatcagggtttatgcatttgtacactgatcctcgcacatttctgcatctccctgcttcataatttcataatcagttccagatttcctatttcttccacatcgtaaggcacagagttccagatttgagagatgcaaggtttaagggtatgaaagtgcagtgaaacgtacgataataataaaaccaaaactgaagttttgtttcatacccactgagaagtaacaaactgagtatataccttgggacccatctgatcttcagaaactgttggaacatggtagacatgtacaaaaatttcatatgtaaagtggatcctttggttggtagacctccttaccaacaaagctaaaagtgttcctacattgctataataaacacatcggatttggatatgcctgccaaagcaccataacgcttctctcaaaattcagaactctgtctctacattacaagacagagcaaactgaaagatcaggttaatctaggataaacttcatctcttgagttcaaagacaactggcctctctaggggtttcaatcaagggttctttgaaggattgctctcaaattcattaaagaaatttcactgacttcacagactttggcattaaatagataacctgagctcttcattgcctggcaaaatgactgttcacctttgaagctctgcaaattgggattaagttggctgtttgccttttacctcaaagatgactccactccattgaccagcgagtccccaggcaatgacctggttgatcaatgacatcaaatttatctctacaatgtgtctcttaaaacacccatcctttcaacagattggctttgttatgatttttgctttagatgtagtagtactcttgataataatgccatccccataataaaaattcaggaaatgaatcatattttaaaaatccaagtgtaatttccagctaacttgaaagatgtgtggggtttttagatgtataaactcaacttttaaaccctgctttgaatttcgcttcctcaattaccacagaaaatgaggtgtctcatcagaccctggagcgagccctaaagcagcacggacttgcttttcacaatgactctgcacattccggagaaggatcggcataaacacataggttttcaccctctaaccccaccgtctgcttcctctgtgccccataatctaaaacatctcttcttcgcaggtatatggtcttggatttgtcacagtgtacgggagactttacaaggccaataaaatgacagctgcacagagggaactgggtggcttttaccgactctgaaacaccactgcctttaactcccagggatcaggaacttgaaagcactccgattcacttagctctgtgtttgtcataaagttaaggctaatcagattttccccaacttgcagccctatcttaaatcctcaagctgctcctatgcaaacttaactgatggaagatgtgattacgccttctcaggtcataaattctagatatttataacataactgttgtcatttaggccaattaagatgcttttactagctcggaacaactacctatggggcttgtcaaatactctgacagtggtttatgacccttcacagtgattttatcttatagggatatgaaagatggttgcatgcaaaaatagccaggaggccttgaagcacattcttcatattagcatcatccataccccatttccattctgtcccctttcttatccactaaaaccccgatttgactctaactgccccccctccagccagagttggtttctttgatcaccttttttttctccaaagacctaaaagagggagataacacctcttgagacactactataaaacacccaagtggtgggctggttaaacgcccagctgggaatgccagacttccacatgcataacatgtccctaaagacaagtgggttttccttttcacttagggcaaacactccctcatgaaaagcaaaagagggtgggtgacaacaaagaaagaacgggacatatttggggagttcatacagacaggttatagcttctccttttcctttgtgaaatatcgcttatctactactgttcccctcctgccgtttcttcttttaacaaggcccccaagcactgatttcaggcactgtactaggctagggatacagggatcaagaaacactcaggctggctggagacacagacaccttgataattataatgcaaagtgttaacaggtaacaggacagtcatgcacagcaaattctggaagcactgaaaagtggcatttcacttttggaagggaggtggtcaggggagattccttgggaaaaagaattcctagtctgggccttagaaaatgccaggagacagctaggccaattgggggagaaaagtagttccaggagggagagaaagaacaaaggcgtggattggaggaggacatgggatacgtggaaaatgccaggcaggtgagtgttccagagcatcacatccctgccaagcagcagtgaaaattgaggctggaaaggaaagtcagggcacactcctgtgggactttgtattcacatgacataagctatttcctttcttgttcaaaggaggcctggtataatggtgctcttttcataaacctaactggacatagttgggtaagaatttttccatccgaatctgtttgcttcgtaccgccatccatagctggcactgtcaaattccccagactaacttgacagacataactgtttgaaaatccggccacacttcccttggtaaagaacgctttgctttcgatgaccaaaacaacactatttgtagaagccaggtaaagcacccaaaattccacctgatataacaaatatgaagtgctgactccatacaaagtcctattctgggaatgagtcagaaatgtggtggagaaggcaccacctcagcagccagtggattctcaagtagacagtgacacatcatggatcttaaaatgtaatggtcttttatcaatgtgattttttccttgtgtttctaatgatgacaatttgattgaatttgaccaaaggaaaaaaaataaaaagtacaacatctacttggccaaaggaagataaaagtgtggaaaatatatcatagcatttgaaattctgcagtatgggcaaatgcaagctaccagcaatttcttcaaattagcagcttaaatgtgctacagagacacaggaatcagagtagcagtgctaacctaggcagtcctcaaaatgatcaaattggagttcattttcaagaatcttatggaagtttttgctgctgttaaaaattttaaatatttgactttgtttgtttatactctgccttggtccagaaaggattaaagcatctaataccaaacagaagagggtcatattactggaagagtgagtgcttgagttcctcctcctcatattagaggaggagtgagggctccagttccatctgccatgcaaacgtcaagttggttccgaccgagacttggaccatgctgattcaaacccagaaaatgtttctaaaccagaacattctgattcaacacaaaattccccagctgtggagcaacaagggaagaactgtgaatccacttctagaggaaggctgggaaccaatgagctttatcagctgagcaaaattccagataaagaattcatgttctctgatttgttctccatgcccacatgtgacttgtttctgacctgaggatggtataaagtggcacagtgcagtgggaggcacaagccccactgcctggtttgcatttcagtttcaccacttgggcaagtcacctgagctttcattccctcagtttcctcattaccacagaggattactgtaaagactgaaagaattaatacatgaagacagtgcctggcacatatgaagtgctcaataaatgttagctgtaattatgattttctattcctctgttaagcacagagagaactacagaagtaaagacccctactttgtcatgttaagtatagtgaaccccaagtttctcttcaaagaatcagtatgtcagtatgttcagctctcttattctttgattttccattttaaagtttaacttcctggttctcttcgccctcttgcttctagtttcagtaaacaacatttttccaccagttttaatcagtagttcacatctgttcccctggtcacctgctttgacctcagtcatgcctggtcacctgctctgacctaagtcccctttagttatctattcctaactgtccttcccaccaaactattcaccctgccactctggttcatacccctgctctgtttaaaatagccaatcagaattagcttagactgagcagtccaaccctagccaatagaggaacgacacagcagtagggtcctgcatcaggaataagaactacttcccctcccctgtccaggtgtgctctcgccattgttccatctgcaaggggcaccctttctgcagaaagtaaaaattgacttgctgagagaattaaatttatgttcaagtgctatttctttgcagcactgggtaacaagcattttgcatttctaacagtctatagggaatttccagtcttgcttcatgtatgattgccaaaggagaatctgccaacggtgatcaagagaagggaattccaaagaaaattgggttaggactccaacagctcaagagagaggggtttatggcatattcagaatttcagaggaggtttcctaaaggagcatatctgggctgaatccaacaggtaggatgtaggcagatattgggcattttagataatggcaagcaataagcacagagatgtgaaaaaaggaatgaacactatttttagaagaggaaaaatgatacctcattatctgggaatggtggaaaattcataaaactgcgcaggggggcccatgcgggaggaatgtgaggacgagtctgaggtagttgaacctaatatggttggaaataaagaggaactgacaatgtgtcgccacgggagggacacagagaacgtggtgtttcaggaaggtgaacatggctggggcatgcagggtggatgggatgggaaagttctgagtcagggaaaccaccccagactggtgctgagaggacagagaggaagtggtggatgggagaggtgccctgtgggaagaacaggctggccttggccagtgactagacatgaggtgttaatgctcagggtctggagtctgacggcatgggtctgaggctcagctctgccactcagcagccttggctcggggcactgactcagtggaaacccagctttttcctctgcaaaatgggaataagtgtgctgacttcacctggatggaaagcacttagcacaaggtctgctcatcccaaagtggtcaataaatggtaaccatgtctgtggtgtcggtatgataaagaaaaaggaagaaaaaaaatgagaaaactgaggtttctacctggtcctgaagccactgaatgagacacagtcctggctggtccctagttccctcttccagagacctcattaacatttaatatcagccacttaatgcctgataaattaagatgtcagtgtaaatggaggcttgtttattatgtcccttttattacataccccatccatttccatctctccatggaaaccaagtctttccaaaaaggaaaatggtgataaccttgttttatttaaaagaaatagcttaggccaggcacggtggctcacgcctgtaatcccaacacttagggaggccgaggtaggcggatcacttgaggtcaggagttcgagatcagcctggcaacatggtgaaaccccatctctactaaaaatacaaaaattagccaggggtggtgatgcatgcctgtaatcccagctacttggaaggctgaggcaagagaatcgcttgaatctgagaggcagaggttgctgtgagcccagatcggaccactgcactcaagtatgggtggcacagtgagactccgactcaaaaaaagaaaaaaaaaaaaaaaagaaaagagaaagaaatagctaagttaaaaaaaaaaaagtaagtgcttttcactttatttcataagaagagggaggaggaggctgggcgtggtagctcacgcctgtaatcccagcactttgggaggccgaggctgatggatcatgaggtcaggagatcgagaccttcttggctaacatggtgaaaccccgtctctactaaaaatacaaaaaattagccgggcgtggtggcgggcgcctgtagtcccagctactcgggaggctgaggcaggagaatggcgtgaacctgggaggcggagtttgcagtgagccgagatcgcgccactgcactccagcctgggcgacagagcgagactccgtctcaaaaagaaaaaaaagaagagggaggaaaaaagatgacacattgtaccagtgattacctgcccattttaagccctgtcagcaacacaaagacttaaaccgaagtgaaatacagggcgcattatccctttaagcccttgagttaactcaaggggactgaaaggcatgtctgtatttctacaggaggtttgtggtgggttcagaaaacatttaaagaagtaccctattatctcaggtaggtgtgttccaaagaatctaaactgaatgtacgtctgttttggttcctgaaaaatgtttctcagctactttcgcttcccagagtccatcttgcacaatacaaattacagaagtgagttgcattttacctagtaagtctggaatgagcagctaaggaagtggtaacacagggaaatgtttctttagcatgcctttttgacctttgcagaactgtccttgatggccctgagcatgccagcctttacctcccagttaagcttgaggtatttggaaaacaagttttgaaaaaagccacacaatcaaaggaggtcaggcaaatgacttggtactgatcagcaccaatgattagccctggtggttactgatgtaaggaccccggatcctttaagaaaccagaaggagagaaatgatggagtaacttccctaagtccgctaaagcatatttgctgagaatatgctctccagtcagcctaggctctggaatccctgagcaattatcattttttccattctttacacatgcaactcattagcattacagcataaatgagttttactagccaggtctgcttatttactgaataaagcccaagccagtgattgcttttattacagaaggaaattcatggcttctcaccaatcctttggataaggtggcattggaaaagtaacctctaaccagacacatggtacagaagaattgctactgctcaccagagatataaaatccaaaaggaaatgactttacccaccatagaagctccacagtactcacaacttgtcatctgtgtataacagcacaggtcataggtcctctcagacctggagttccttcaacacgttcagagccaggtgaccctggacaagtaacatttctgagtctcagtttctagcctttaaaatggaaccaatatctactcacttcacaggacattgtacaggtcaaatggattagtgcatataaagtctttaggattatgcctggcctgtgggaatcatcccagaaatatctgctattgctattaatgtaaaatcaaaaaagcacaacctctatcccactgaacagtgttgtcattcagggctctgagtaaattattttcagtggataaatcatctctgaatgagacaggaacaaactgaaacttggcttcagctccacaaaactgttgggtccactctttcttcagaaatttcttcttttggccgggtgtggtggctcacgcctgtaatcccagcaatttaggaggccaaggcgggcagatcacctgaggtcaggagttcaagaccagcctggccaacatggtgaaaccccatctctacaaaaatacaaaattagtcaggcatgatggtgggtgactgtaatcccagctactcgggaggctgaggcaggagaatcgcttgaacccaggaggcagaggttgcagtgagctgagatcacgccattgtaccctagcctgggcgacagagcgagactccatctcaaaaaagaaaaaaaagaaaaaagaaaaaaagaaatttcttttttctctgggtctgtttaacaatcatttttagcagagcagatcagattggccatatgggtgagccaatatcgtcaccttaatatttagaagctaggcaagattaatgagaagatgagtgtcttaaagccacagaaacacaggaccatagagctgctcaggcccttgagaaccttttagtttaactctttcttgatagagacatcacaaaagaaagtgtctttccatgggccacaggtcatgaaagagacagaagcaggactgaaatcatcaatcaagggactttctgtgaccttccatttttaatttaaaatattagatgttccttggaattttaatagaacttggatgtaaaatcatctggactgggacttggtgcttttttttttttttttttttttgaagaaagggggcgggggtcatattttagctactgatttagtccttttagtggttactgatatatttaggttggctttctatttaattttgagtaagtttagaatttttttcagaaaattgtatctaatttttaaatatattggcacaaagttactcataatatcttttattgtaaaaagtctctttgtatctatagttatacccccatttttcttcccaaggaagcattttgtatcttttctccttcctttttcttgtttaacctggacaatgattagactacagaggagatgtcaacagaattttctgcaacaatggaaatctattatctacagtgtatgatatgaacagacctgcattgtccaatactgtagcactagccactagctcagtgtggctgttgagctccttgaaatatgactagtgtgactgagaaactgagttaaacattttgttgcattttaactaatttgaatgtaaattgtcatgttaccatattgtgtcatgcaggtctatgatatacatagggtcttttcaaagattcagcttttattttgaaaaccatctcatattatttttgttgttgctattttctatttacttatgcctttgccttaaacatttttccttccttctacttctttctgtttactctgactgtttttatgaagatcaatcagtagccaagaaatagactggcacagggttccatcgaggcccaaatcccttcttccttggattccagtcctaaaggctcagtaggaaaggcctgggaaaatgtcattgaaaaaagaagatgaaaagcggaaggcttctagatgaaggccaagccaggaacctggctattaagaatattttctctcctccccaaaatgagctggttgaatccaatgtgacactgaaagggaaatcaaaatgcctgaagaacaagttgtagatttgaattctcaagtacctgaattcctccttgggactgaagcctctgacatatgatactttgtagagagtgtcctgctagccatgccgaaatctggacaccaagaacctttcttatatgaatgaagttgagaaccaggagctttgctatccagggatttcaccatttgggactaagaagcagagatggaaggaaacagatgcagatgaactactgtaaagggacaagaagaaatctccctttgcctggagggagtctgtcttcagacttgaagatgagacccaccctccataaagcaaggattcattacacttgcagtctcctgggcctcgcggctcacttggagccactgagcaataaataccatgaagctcactatcatagggatgcctagggagtggggtggcagagatgccatggctcccagagatgatcggaagccagtacacgatgaactctagaaggcttaagctgcttctgctttgatgcctggggttgggaggaagccaaaaggcttatcccaaaaggactctcaaacactagaaataaaacacattgaaacttacagtgacttggagagcatgttaggtaaagttagcttatgacttccagttttcctggtgattttattacagtaattcaaggtttctcataatattccttgcttcttgttacttttgaattgtattctaaatgaccaaagtatcctaaacacctacattgcataattacctgtatactcagaaagagactagctgttccctgatcatgtatttccttaaacaaccagttgcagagctgggcactctgccagggctgggcttgcgatggtaaaccacatagataaggtacttctcatgaatagatgttctactgaagacaggcaaacatgttaacaaataaataacttaattcatatggtgacaagtattatcaacagtataaaacaggggaatgtgacagacaggacctggagggtgtgggagtcctcttcaggaggttacagataagctgagccccacatgatgagaaggagccagccttctaaccatagagcgggtgggctccaagcatatgagacagcagtctcagaggtcctgcgtggcaataagctagtcgtactggtggggaggggtagaaagaaagtggggtaccatgaatttggtaaatcagtgcaaggctctgtaacaggacggaagagaagacgggagccagactgggggagcccttgtgagccagtaaggacttcacattaattaaaggctcatgaaatatttgcagctactctcctaaagcatactatcagacaagacactttttgttttgttttgttctgtttttttgagacggagtttcgctcttgtcgcccagactggagtgcgatggcgcgatcttggctcacggcaacctctgcctcccaggttcaagtgattctcctgcctccgccgcctgagtagctggaattacaggcgtgcaccaccacaccaggctaattttgtatttttagtagagacggggtttctccatgttggtcaggctggtctcgaactcccaacctcaggtgattcacccgcctcgaccttccaaagtgctgggattacaggtgtgagccaccacgcccggccaataagacagtttttatacttccttactgactctcaaagcaaagtagaccctgactgtggggagaaaggggagattacactggtactttttgcagattatactggtactttttgctcaatgagttgggcaagaaaccaggtccttctgagacctcctcatgtgtctgcagccatcaaagacactactgtaggggcttcacagagctcacgggcctccctggtggacacaccgtcaacttggataggcccaaattccttggcagtcatccctgcttccgcctctaggttttacacaaagatttttttctttttttcctgccactgggaaaagtacataaaaataggtgtgccacttgaaaattaaacagagagtaaatacccagagtatccgggctgtgatctagataacactggagaatctaagagtgggaagtcacgtaacataaaaataagaaagaaggaatcatggcagtaatgatcagtttggaaaaaaaaaaatagatggaaagaatttggaaggtaacaacttccagatggtcctggtggtgaagatagctatatatagagaaagagaggctaattagttcccaggctgaggccctagtttctgttaagtaagtgattgtctcatggtggtttagttcaatactaggggacacacaccacattgcgagtaaattaagtatttggggttttttttttccccaagcaatgggaattgcccaaccttaatacaattaattaagactcaatgaatgtttaattgagttctggtgcttgtaccagggacacaatgggctctttgttttggccaagctcctaaatattgggaaaaggaagaaaggctgaaaaagagcaagggttagtcaatagctttcccctaaatgctcagatgcacaagttggtttccaaacataacagccaattcagtgaaatccaggagattgcccttggaggaggttgtggaccttccaggaagaaaggaaaaatattgcctgacacctccaggttggcactgaaagttacaagctagtttcaaactcctcctccaaaactctagctctgccaactaaatggaccatctttacagtgtacactcaactaaactcccacttggtttcttcctattgtggagtcaggggctctcagcagtgaaaagaaggttgagaaaatttaggaggtgggaagagtcattggaatgctctttccagaatactgtgaccaaatggacagcttttggccagccaccaaccatcacctgacaggtggctggataaagatgtggggatttttatcactctcaaatccacactgttggcttctaagagaattccacaaagagcaacaataacaattaaaaagtgcttccatttgtttaccatgtatctattctatcagccctgtgtgtggcattccacttctattatctcattcaactttcacaacaatattgagtggtcagccctcttatcatctcccctggaacatatgcagaaactgatgctttgagatattaagtcctttgcccaaggtctcatagctaataaatggaggaactgcgattgcaaccaaggatgcttgaccttggagtctgcactgagtcttgctcacacctgatactgtgctgagttactctctgaatgaactcccactgggcagatgagctggaggaactgccaaacagctggttccctctatgcacaccagcaggggaagtcttgatcctttggccaaacaggaaatatgtgatgtgtgcccatatacataccaacctgcagagctgccaagtggcaattaacactgtggatccctatagaacatcagcttctcatcttggtccagttgtacctgagaactaactgattggagaagagaagcaaggaggcccagggtaccagggtatggatgaccatgaggttcaagctcatatttttttttccaggaatctggtcttaattcactgctggaaggctgtcaggctctgggaaaccaggtgagatggagacaaggaggcaaggacttttgcccccaatatccagctctctattctcttaagtttggtttcagtggaagcccaaggggtggcccaaagacatctggcttggccatgtgttatgtcccacccccactccatcctataggatctttagcagcctgagatgattgcagtcctaatctagaactttgggatgactcaaaagaagatgtaactcacctaaaccatcattacatcataatatttagagctggtaggattcttggggataatttagaccaatatcatctctcaccccaattaacaccaagatcctcaatataattctgtgaaagaaaggaagagaagatagaaggagtgaagagaagaaagaagaaagaaaggaagttggttagtcagctagctgtttctgagaggctaaagggtcccaaattagtttcgccaggactaaaccacaagtgttcaaattcctagtatgtgatcttcccattttatgaccttgtcactattttttccagagtacccattgtccacctgtctatttatccatctaatcaagagaagccttattgcctattatctcctaggcatagggaagtgcacacatgagtaacctccctctttggtgggcttttgtgagctctaggataagtaaccaatgtctagtactgtgcctgaccgatatcagcacacaataaatatttgctgaaaagatgcaagaaagcacccagataacataatccagggtagaacataaggacctaggaacacccccagcaactgaaagagtacctgacatagagaatgcattccataatgtctgctgaatgaatgagtgagtgaatgaacaaacagaattgagtccagcaaaacctgcactgtgggctttaagaacactaggcagtagggtctctggagggatgactccctcacatgaccttttctagggggtctaggattttataaaataactctatatcccttccccacgaaggttctgaaaaggtggaaaaacactgagtggcatatctgtctccctctactgggctgtaagcttctcggggactgctccttatttcaagggcctggcatataatagatgtttatttaacaggtattgagaaagcagatacatacatgaacactcaatggcctttcattaattcagcaaatacttatagagtgcctgctatttgcaaacactggcctagactctggagctgcagcagtgaggataatgggtgaaatgtttgcctttatggagcttacattctgctgagtccaggaagagtgaatatatttctcctttcatatttcattcaaagcaaaactaaaccttaaatgatttcatccttcattctttttaatcaacacaaagctgactgatgcacatccctccagtccccttcgtttctcatcacaaaacacaccatgcctgggagtcaagggtcccgggtgggaaatgccacatattctgcccacctcccacatggcctctatagagacttcatttgtgttccaagatcaggggacttgccactccaaagcagccccttcagatgtggtcagtttgtcagcacatatcaaatgcagcagagacctctgcattagggcagcttagcacaaaagggtctggttccctcctcttcctatgtatgtggttttcaggcagctctgaaggggtggtgaggaatgcaggtcacagaatgccccagacacgaagacagtttataagaatctgcccatgccataagtactagacaaaagttgagtttattttccttgaatattacactttatgtatccatgcattcccccaggatatccaatgcacagactgccttgaagctacttgggatgtatgtaaaccatacattcatgctcctactatttattgggaccagcctgctctatttctacgatcttggccaaattctacctattgaatattgtcagtcccggctgtaacataatcctggctgagattcacatgaaagatgtaatcttgacaagccatttagaatctcttctaaaaaaacgtaaaagccagcattcttccagaggaatgaatcagtctgataaaaatgtctacgggggaagcctaatcagttcatacgagaacctgtcagtagaacctctacttagactgtaagattaaaccatcttcatagtcattagaaggaagtgtggtccattcggctaagatggtcttctcctatttccaattagaaactctggtttgcatttatcacatggagatgctggcaaaagctgtgtctagaatgagcattaaaaggataacgcaatctcacttttgctcactaatagtggttcatttttaacctgttaaagcaggagggcaactcttccctttcccatagcacttcagagttctcaaagggaaaacctgtctcactttattatttcttttttttttttgacgagtctcactctctagccaggctggagtatggtggcacgatctcggcttactgcaacctccgcctactgggttcaagcaattatcctgcctcagcctcttgagtagctgggactacaggtgcatgccaccacacccagctaattttttatttttagtagagacggggtttcaccttgttggccaggatggtcttgatctcgtgacctcgtgatctgcctgcctgcctcagcctaccaaagtgctgggattacaggcgtgagccaccgtgcccggcctattatttcttttttctacaaatcctttttttgacctcttatccagacagtcatctgctgattattttaaaggtatgcgaatatttagacaaatcctccaagatctctgtcaggttggaacaggaaatgcttcctgtcattttaatgtttataaacattagtggtgaaatcatatcattatgagggaaaacattttcagatgattttttttctttcttttttttttgtctctttgtctcgctctgtcacccaggctggagtgcagtggctcgatctcagctcactgcaacctctgcctcctaggttcaagcaattcttgtacctcagcctcccaagtagctgggactatagacgtccgccaccactcctggctaatttttgcatttgtaatagagacggggttttatcatgttggccaagctggtcttgaactcttggcctcaagtgatccatctgtcttggcctcccaaagtgctgggattacaggtgtgagccactgcgcccagcctcagatgattttctgatatcatttaaagcaactagagttcaagtttagaaacacgcataatgaagaatcatctcaacccagcagaggctctcccaaataagtggcaacttcactcatccatcactttaaatagcaatcgttcccatcagagattttttaatttttatttttattttattttattttattttattttgttttattttttgagatggagtctctctgtctcctaggctggagtacagtggtgtgatcggctcactgcaacctccgcctctgggttcaagctattctcctgcctcagcctcccaagtagctgggattacaggactgtgccaccatgcccggctaatttttatatctttagtagaggcggggtttcaccatactggcaaggctggtcttgaactcctgacctcaggtgatccgcccacctcggcctcccaaagtgctgggattacaggcatgagccactgcacccagcctccatcagagatttataaaaatgtattttcaacattttaatctttcttcctttctcacagtaatccatattcacagggcagaataaggacaaacatggaacacactgtcaaagagtaaggctgacagtgcagagtctggagactaacaagcctggttccagtccttgttctgctccttgctgttgtaaccttggggaaatcattcacgttccctcagcctccatttccccacctgcaaaatggggtaataacatcatcgcctcacacagctgttataagattgagcacagcacctgggacactttgtgggcttggcacagtgcatagagcaccttagatgatcaataattacatgtgttcaatgaacaaatgagtgcatcgatgactgaatctcttcctacccaaactataatacactaaatcaggggtcagcaaacttttcctgtaaggagccagcaagtaaatatcttaagctttgcaggcaatatggtttctgtcgcaactatttacctgtgttgtgacatgaaaccagccacagaaaataaacgaagaggtgtggctgtgctccaacaaaactttatttacaaaaacaggcagggcactgaatctggcccgcagccctacggtttgcagacctctgttctaaaggcctaccttgctaatgacaaaccagacctgatttgcaaaataagtgctcagtcatgacttataagcctagtgttagaccaaatcactccaagggaagctaggaggccatgagaagtcagtccctcctagcttctctccaatcattcactgtgccctgtcacacacttcccgaccattgccaggacctgttgtggtctcacaggtgtgcccgttcactcctgtcttcctgtccctctcctggggactggcccatccagtataacagcctgttgcacccagttcctcctgggatcaggcctgtggctgaggccctgacaggacaaaggtcctcctggaatgctccccttcttttctttctcaaaccaatgatagcactcctttgtccaaatcctcagagttggggatagaaactttctcatctatgtctaggcagaaaaatagaaatgtaattccttctcattctccctttcacctggagagtacagaaacacactgtggaatatggaaaggcatgaaccagagctgctcaaaggatgggtgggagtgcgcttaggtagcatctctacctgctgaggactcatcaggttccaagcactgccagggaccaggcccatgtgcagagggagaagtggagttcagaaggcatgaggggcttgtgtgaaggcacagactgggagcagagactggcatccaggctgggctgaccggggtctcctcaactctaaaacccaagttactgcaaactctaaaatccaagtctctgcccctgggtgcaaatggcagcttgaatgcattgagtactcactggagccagctttcaaatgcagtacaatttgcaagcattttacttattgatatgtttagttttttttgttaactccctactagacaatcaagtcaaaagaacctgctctctctatcgagcatcgtcactggcacactgtaggtgtttattacatatttgtagaatttgttaataaagaaaaataatgtgaatactagatagtagtagctatctacatgggctaagaatttgacatgcattttctcactgacccctctgactcaagttagctactgttatttttcccattttattgatgataaaactaaggatctgaaaggttaacacttttagcccaaggtcagaaagctaacaaatggcaaaagcaataattgaacccaattctgttaggctcttaagccagattcctcttactccattcatttctccccacacaatgatttcccttgtcccaaaccagacagtgagcccgctggcccagggccccattcctcccacaacaaaaagtcatcttttctctttccccctgaccatgttcattcctagtgtctggaaactgccctcacctataaaatcaggataattttccattgtcaacacacatcccaacctcctccatggggtttttgtgagaattaaccccatttgcagccattaattaagctgttaaaagcacaagtagctttttctccatttttacatggcttctcaaatggttaatgtcgagttctttcttggtgcaagcacaaggagctcataacttttcaatggattatgaaagttattccccgaggggctcggcaaagcagtcatcgttgtgcatagctttggcattacgtcagtgaatttagtccttcctgagctaatggtggttcttaataatattattggaattattattaccttcaattaaaatgttggccatgaatgacttactacttcagagagattccccaaagagtcacgttagagtctgtagtctttctgctaaagggcaccataagaacaggaaccagagtccttgcccatcccccaagtaaatacattaattaataaatacacagcattcaaatacttttatgttgttggctggttaccaggttttaaattgacttccttaagggtggatagggctggctaatcactaccactttgttctaaaaactaaaaggaaatcaggaaaactttacgcattgttctttatttctactcaccaaactacattagaatagtattattggtacagctacaaccttcacagaatgacctccatcttatcttagtggagatggtggacagcacagggtttggtttcaaagacaataagatgaatggtacctggtaaaagcactacctatgacatctcccttgacaatacctgagcgttgagaacaccctatagaaatggcttcaaaaccaggcaaattgctcattggattcagggtcggtgagctatctaactctgcatatgtgcatagaggtggaggaagttctcaaacaaagagttgaaagaagtgtgtaggctgggtcaaagaggactttggctgtgtccagaatctgatactcagacagtatgaaaatgtgtcaccacttctagggagaccaggtaggagaagagcactaccttcatccacagggaaagtagtgctagcatgtcccaaccccaaatggacagagagagaactatctcaagggtgtggtgatgcgtcttggaaatccaggtgctgaactgcaggggaggaatatctgaggccagcgaagacaatgtattcacaatcaggagactggggaccaggacatgagccacagagaagcctggggagcctacaggagggagagaaagtataggctggagacaaagaggaagaagagtctgggacacactgtctggcacaaaatagacacagaaatagttgttgaatcaatgaacaaacaagtgaataactgggggagatctaacatcctagcttggcctgaaagctctgttgcttaaatctacgtcagtcaggaaagatttcctgtgtaaataccttggctgatttcgatccttatatttagaaaacctgtctcttgcttttaacccaaccaaacctaattcaatctacttgcctgaatgtgtgatactttggtttttgtggggtatgtgtgcgtgtgggcacacgcacatgtgcatgcacacatgtttaattttcatttctaataaaattaacttaaacccctgtgttgccgatgagtttatcaagggcaggaagcagatgttttcacacttggaccaaggctgagggagaagaggtggtgcgacactcaaagtctcaccgttgcctctaataagaaggaggcagatccacacagggcaggagccccagggaaagctatgtcaatgtcggagggagcagcttaacgagcgctgcctggggaagcttgctctgcatgatattgaaagatgccacaattcacacgtcctgtggctgcacttcacctcccccgcagagaagtctgtggctgtgttagtgcagccacacccttgccttgattttctgtcatcctctttggtaactaacttggacttcctgcttccttgatagcccattcttggtccatctgtctttgtcaaggaatgagattccaggtttttctacaaggctcacattccaagaatggccttgtagcctgattctgcccaagtttttgcctgttcttgacatatattattgccttctctgccacacctttctaacgatcctaccttatgcacagccctggaaagagaaaccccacagacagcttgatctgccctaacttgtacagagttgactgtaccaagttaggactcctgcttcaggcaaatacatctataaggctggccagtgccatgtagcaggtgacctggttctgagatggattaatgagcttcctcccctagagattgagaaagagggattccaagagactgaaccagtccatgataaggttgtgggaacacggaggctgtggtaagggcatgaggaaggtaaagaacattgaatgagaggggacagaagaccatatgagaaagtagaagacaaacatcctgattttccactccccagatggagtcctgtgtagctcagctacccctctagcccttcaactccacaacagtccctgcaggtcttcaacaagccctgtaggagacgttctttttgcctgttcattactcagtacaatttatttttgtaacagtactttgatttttcttttggggactcacacttctctcattctcagactgtggggagcgaacacgacataggactagtcaattaaaataacttatttcttagccatatagtaattggttcatggataggaacgcgacaaaagttgatacaatgacaatccatcggaggggagaaagaggcttccatacatctggggtgtccatactgctatataagcatctggggctgtcagcagctgtttttctattttatggggaatcttacaatagaagtctgctagagaatgaaatccccttgggggaaaacaaagccaaaagatggtgaaagacagagacccaatgccattgtttttagcccctagatgcagccatacctgaagtcattataccctgacttttcagatataagagccaatataggccaggcatggtggctcacgtctgtaatgccagcactttgggaggccaaggcaggcagacctcctgaggtaaggagttcgagaccagccatgccaatgtggcaaaacctcatctctactaaaaataataaaattagctgggcatggtggcgtgcacctgtaatccaagctactcagtaggctgaggcaggaaaattgcttgaacctcggaggcagaggttgcagtgagccaggatcccgccattgcactatagcctgggtgacagagcaagattctatctcaaaaaaaaaaaaaaaaaaaaaaaaaaaaaagccaatatacactccttcccttttaaaaaatagtttgaattgatgcaagactcttgactattatgtatccttttaggatccagatagcctgtataggttcctatttcttgcagcacaggaaccttccctactgatgcctctctccttttccttctactgttttggttatcatgaataaggtgttaaaagaagagcagaaatttcaactttaggtgccttagtgcctttgtaaactgcatactcaaccatctagccatcttttccatccatcttactagcccattacgtttctcagtttgatccaagtagtcttaaatgtcttcagagggcacaaggaagattacaaagactattttaaggtgaagagtagcccattacttccactcaaattctattggccagaaatcatttgcatggtggagacatgcaatgttcccttactcccaggaaggaggaaccctagtgagtagacactgtgtgctgcactaacatagtactggcccaagataggcactcaatatttgctgaatgaataaacaatgaggaatgtatagagttggggattgtaagtaattcagagattcctccttacactatcaggcaaagaggaaaagccatatcccactgtcattcatgagtgagcatgttctctctccccagggaaataggctaagttcagtctctctgcacattcgcccagattttctctctggctcctacgctttccacagatcacagcttttttttttttcttttctttttttttttcttttttgacagagtcttgctctgtcgcccaggctggagtacagtggcatgatctcagctcactgcaacctctgcccctggggttcaagcaattcttgtgcctcagcctcccaagtagctgggactacagcatgcaccatcatacccagctaattttttgtatttttagtagagatggggtttcgtcatgttggccagtctggtctcgaactcctggcctcaagtgatctgcctgcctaccaaagtgctgggattacaggtgtgatccactgtgcccaaccagatcgcagctttaattgaccaattttgttttctacactgatttgctctctccacataatgatactgtgccattcctatgtcatcccaaagtgtgccaaatatctcatcaggtggggtgaagggagaggaatggaggagtttgcttgttaaattcacattgtatatggatttagaagtgttttactctcaagactaagcagttcagaaatagatgaggggcaatattttcctttactggaaaaaaaatatttttacactgaaagtcacatatatacaagtgtatgtatgcatctatctgcctaaagaggaaatcattatgaaatcttgttaccactttatttacctggttttatattttcatgggcaaatatagcacggaaatttactaaatttactcttgagtattttagaggcagtggctacccagtctggagaaacttttctgcaggacccagctgtggatggggctctgggagccagtcttcctgacactgcttggtaggatcaaagtgttttgtttaaaggaatattttcagagaattataatgtaaatttaaaaatgggattggcaatcatcatagatttagaatgcaacttaaaattttttttaaaaatctaggctcacctttccttgaatacttctttgatactgatatttccttgattgtggggaagatttttcaaaatcttattctgccttgaggtaatcattatgagcatcaatcatcatcatgtggatatagagcactggcaaggccaatgttagataaaagagagtttctaatgcctcctctagggtgtggttctgttttcaagggacttgccattacatccttgaactgaattttactggacttgaaaaaaatttgcatgcaaattccttattagggttacaatcttgggcaagccactcaatctgtctgtacgtcactttcctcgtctgtaagatggagataatgataattcctacctcatagggttatcatgaagattaaatgagttaatgcacataaaacattcaatagagtttctggcacagagaaaactttagctattattattttctcattatttttaaacatatgtattactgaacaagcatacctttggagaaatttatggtttccatttgtagtaaaatcagatgtaagttggcatctaatgttgaagataaaatatttagagaaaaaatattaaaatttaaatactattcagactctgaattattaatgcaaagcagctttcactataaatatttggtctctgagtttcaagataaatggaaaaaataatgaaaaccaaactcacaaatgccctccagacatggggatgctagggctagttaaaatatgactgtggatgcataatgatttgggggtctttacggacaggatgaaaggggtcaagcagatgctgaggagggcagggtgtgagagggcagcctggctctatccgcaggcccagtggccggccagtccacccaagttagagcatcaatgagctgtcaactagttggttgatctcagcaagtcactgaagtcccagtacctcccttttaccatctgtaaaatgagaataataataatagtcgcactctcttcaacttaaaaagaaaacaagggagagagaatagaaaacacgtcaaaagttaagggttagaacatgtaattcttctaccacaaacaagcatttctatgggaataaagaaagactttgtgaaagttatttattaagaaaaaaatgtggcatggtatatggacatataaagttgacctgatgtcatagaaaaagtgtggacgtaagccttagaaaacccaagtgtctgaaaagtaggaccaagcacttattaaccttgggcaagtcacctaactttactcaagctcagttcctctattagtaaaattaggacaatattacatgccccatatggtcactgtcagggacaaaaaaggctgaaaatatataaagtcatctggcaattaataggtacttaaatgtatgtgcataagtgtatgtatgagtgtgtatgtatatatgatctatatgatgaataaataatatataatttggagtttggtgtagatttggggttatttatatctatgatctagtatctgtgatccccttggatagatatcaagagggtatgtgaatcccttgaaatttactttatgcttgtgcattttctggggagagagtcctctgttatcatcatgttttccatccaaggagcccatgaccttgaaaaagattaagcatcaccagtgtagacagagagatggtgagagtgatgggtagctttgcttccatattgctcactacccataattcagcatatctatgcagtggtcatctagcgtgagaacttcccccgtttaaatacacaaggttctccttaccggagaaaaactggaacctggaagagggtacttgtctttgacagggaccaaaatttcaaagtaaatagtgggaaagagatctgggactttatctttaaaaatgagaccaaaatttttggaaatgagtatatgtatattatttttaataaattttaaactgtaatttcaacaacttgccagttttataaagaacaaagaataaaatatgggttgatttatttggcccatgtcttcccaatcaggttgtgtgagggcaccacgtgacctcctttactttcatcagtacagttgttaacagtcttatttttttaagagtctgcaaaaaaatatttgagacatgtgccactttcccaagaacctgtcataagcctctaacatccaatccctcactttgaagcccttgggctgtcatcatgcttattggcttttctttttaattgataacaagttatcttcttttgttaaggaatttgtatgtgacacaaagctggcttccaaaatccctttcatcagcttgataaagccttgcatcttttgaaaaatgtgctgcttcaattggcaagtgttgtgcaatctattttcactgtgtttcttgatgctggaaacatctggatgatccaggaaagacagatgtacatagagttgactctcgacacagtggggggcccaccgttaaaacgggaaggatgtctgagtggggctaatttgataagtggtccattaattcatgaatgtttcaatgttatgacaactttggctttcctgctaccttttaaccatcaacgttggataatgaattttcggataagggaaaaccaaggtgaatccctctacggttagtacaaactggtaccagcttggcgcaaggagaagagggccctttcagtgcattcttccaaaaaagccatgttgcacatagtggctggtgagggggaaataatacatttcaggcaagtgtaggttaaataagcccttgagaattagtctatgaactctactctagtggaaaatgaggcccacattccaaaccaatttcacaacgcccccatccccctttttaataacagcccatttttacatagggggttgcctattctgcaattctgtaatagtgaatttttgcttattgtgtttctggataacaaggtgtgcctgtgtttctttcttgcatatcggtttgcagaaagtaattgccctgcaattcttaatccaacctgttcacgcattcctttctgcattgttcttgttcgtcatgtctgagctgtcacctgagagctgatcttcctttgctaaaatccattcaagaagcatctttacccttcaagatgtctggtggaaagatacactgttttgactgatgtagcaaaacatttacagagcatctttttccaaagtattatactcttgtgttacttcccaagaaaaaatctgtttgtagaataaaatggtggaatttagatgaatgattgtctttttgggagagtgttagagggttgtcacttagtaaatataacctaaagaataataatgctaatatttgttcctttttcaccgaaaatcttattatgtgtgctagacactgtgctaggcattttgtatgcacaatctattttaaccctacttattactgtccctgtaaggctttttcccccagtggaatgtaagctccatgtagacaaggatttttgtctttttatttattgctacaaccctggtgtctagaacagtgcccggaatagactagatactcaacaaatattttctgaataataaatgaatccccattttacagataggaaagctaaggcacagagaggccagttatatacaatttacataaggtcacaacggtaataagtgaaaaatcagatttcgaacaatatttactagcaaaaaacctacagtcctaaaagatatgctccctttttccatccaacacacacacacaaacacacacaggtgcacaaccactctcagacgcatgcacaaagaagcctgcccagttcacctgcttcttcagctcaccacaggccgactgctgaaggacacatttttgttacccatcctcctcctcaaactgtcctctttgaacaaaaatcctctgtaggttcctctgctggcagtcttcattagtatttagtgacctcccctgcccagttctcgtttcctgcactacaatccccgcctcccgatgaactgttaattataactactacaaagtctacactcgcctgggagacaggctgtttggcagcagctgtgaaagccgaactaagttctttggggattaatccgccgctgcatgtagtcttacaagtacagctttggaggaaaggaaaggaagataaaatgagctaatgctgttcgtataaatgtgaacttctacataacacacacaggcgcacccacaaatacgttgactgaaagttaaaatatgattatcaaaggataagaaagacttacaactgtaatgtaaaacattaagaaatataccctggctttctgtgttctgcagggatacaagtgtgctctgagccaaggaaaattaaaaaaagagagagagagagacagagatagcacattgaaatatctttacgtagacttaaatatagcttcagagattataattcagatcaaggctagagctccatttcaacattccttaactgctggtaatataacaaaggtctgcaaattgggaggtacgtctgcttgggaagggatgcttatctgatctaggcccatctttcttcatgtttcaatcccagaacagctgcccttcccttggtgagaaactcagcgatgaaggcacaaacccagcaagctgaaagcgcagctggctgtggtcctgctgcagccgcctcgccctgtggagagtgtgcgttggcgggtggagcagaagtgggctacttgggggagtccttggtggctgctggcaggcagctgcatgccccgcaatagggtagtgcccatttgtaacccagcggggggtggtggtggaatacagcaagacgatggggccataagaaggaggcagggccagctgagcttcctgaagctggggataggttggaagggttattcttccctttcgttcattccctcactcgttccttcattcattcactccttttatcttcatttattttactccttttatctttctttactttcccccaaattattcattcaaatattagtagagcaatgcagtattaaaatcaaacgcatggacttgggggacagacttgggtgggacttccagtcccctcaatgtgccagctgtgagacttttggggaattattcaacctggatgagcttcagtgtcctcatctgattagcagacatcttaacagtgccacatctcctaagactgctgcaggacactatgattcagtgataaaggactttacgtgctgcctggcacatgctaagtgctcaataaacagcaggcattaggatgaggatgacagttctgtgggagccacagagatgtgtctcgcaggcggctgcctccaagggccacttgaaagatacccagtctgcatggttgtccctgagcagaggagtcatacatgagtaacaagataaaaagttaaaaaagtaagagagtcccaagaggaaggtgcaaagaaagccccatggagaaagaccatcagatccagagtctgtctattagaagagtatccctttgccctggttcagagacatggctgccgaggactgagccccaggcaggagaaatggtatgttaaggggctggcacacacaaagctctgagccgaccccagactgagagatgctgcttctgcttctgttatgctccctcagaagacagcttttttgtgacaagggggagcggcagagagagggtacaagtgggaccagggaggggacacacaccacggacacactggacaatttgccactctgtagcagttgaacaaggccgggcagggacatgaatgaagattccctttcatcccccatctcagaacctggggcttatcccacagaccagctccccgagtgtcctgaggaacaaaagttctacaagtcatccttccccaaacattccagagacacctgcataaatacacctgtgacaggcataagacttcacttccctctaggagtcacactgtgctcattagcacatcaaaagctctgagaagtcctgcatagacaatctgtttaacttgattctttcaaagttatccaacgctgaattttttttttttttttttttgagagagaggctcactctgtctcccaggctggagtgcagtggtgcaatcttggctcactgcaacctctgcctcccaggttcaagcaattctcctgcctcagcctcccgagtagctgggactacaggcgcgcaccaccaggtctggctaatttttgtattttctactagagatggggtttcaccatattggacaggctggtttcaaactcctgacctcatgatccatccgccttggcctcccaaagtgctgggattacaggtgtgagccaccgcacctggccaataattttttaaaataatgcctttgtcccaatccaatgtatgcgttttatacataaagaagtgcaggtgcagggtgaagaagatgagactctctcgaggccacacagtcagtgaggagctatgctgaacctgaatgctagctctggtgaacagctctttgccctcctcctcatttccccatggagccagggcacccccgtcatgtgccagtgctccttggaataggtggtgacaatgctgacacttctgtcaagcagaagtcattcaaggtgactgccttttaacacacttctaaaaacaaactgtaaaagcctctctgaaatgtctgatggggaacggatttttaaatccacgtcgctggaagacatgcaggtgggccaggaggcagaggggccggcagggaggggcacaaggctctgggtcccaggtcctgaatcccggctcagcccttccactgcccttgctggccatgtgcctccaaccctccaagcctgattcctcactgtgaaacagaggattgtgttgtcttttggtcctggctatttatgactggaaagagaaaggcttgtcagaattcaggttgactacttggcatttgagagagccccacatccaccactgaaacgcccaccccaccacggtgattgtcatgcttctctgcctccttattcatagagcgttccctgcaaaaagagtcctcgcaaggctccccagttctcctagaacattcagtctactgactctcacttaaggctcagtgcacactggataccacccacctctccaatttcatctaccatctctccccccatctcacttgatgatcaccaccctggcctgcttcatgctggctccttctcatccgagggtcaccttctcacatcagcccttcaaactatttcgtctgaggcaacatcctcccctcttggtctcttccccttcatttccttctttgtacttaccactgtctaaaatcatcttacttatttgttcatttatctgcttaatttctgactctccctgagagaaggtaatctatgagggcagagtattgtttattgcttcatatttactgcttgtttacctggcacaaagactggcaaaaagtaggtgcttattaaacttcaattaaatgaatgaagaaattctcttccagaaaaaaagcctgcttaccccttcaaagtccatgtcaaataaagccttctatgaatcacctaggcaaaattgaaaagccaccttttttgtattcctacggcctttgtgtctgcctctcatagggtgttttttttttctttttttttttagatggagtctctggctctgtcacctgggctggagtgcggtggcgcgatctcagctcactgcaaccttcacctcccgggttcaaccaattctccctgcctcagcctcccaagtagctgggattacaggcatccgccatcacacccagctaattttttttttttttttttttttttgtagtagacacagagtttcaccatgttggccaggctggtcacaaattcctgacctcatgtgatcctcccacctcaggctcccaaagtactgggattacaggcgtgagccactgcacctggcctgcctctcataggatgttatatgccagtctgccctcactgctgtgagggcagggacctgtgcatgtcattctgcaagtccacagcctccgccagaggctagccctctgtaggtcttccacagtgcttaaagaattaaggaattgctcgtctagaaccaaactctctctggactcatacaatcagggctttgtttgctctccaggaaagttcagccataagagttttaaagcttacattaaattgtctacatcttcctgtccatgggccttccccaagagaaacatcatctggaagccatgtgatcgagcggacactgattttgtgtaagccccacatcctgggttctagtctcaggcttcagctgggggatcttgaactgggtctttcgcttctctgaacctttatctctttagtttatgaaagagattgaaaaacctctgaagactgccccacccagcccttactggttttgaatatgtggctcagtctttcatattctccctctagcagtccatacatgtggtttgataaggagtaagtctactaggtatagccaaacaagtattttgtcaatgaaatcttaccctcagagaaacaggggatcatccattattctctgattggtgtttttaattagactcattctgccacacacaggcttataccaaatgaggggatttttatatctgttaaaggtccaaggcttttcacagattgcaaaaaaggcaaaatcccagcagctcggaatgctgttgcatttcattttacccagccttgtagattagctccaaagcctgcttggtcagcaaacatttctgctgtcccagaaaagctcttcagttcttcccaatccctatcaagactgtgccaccacagcaatgaggagcgggataagccattttcctttcctgcgaacatttctgggctctgaggcctgccttttttcagattctgtgggcctttgctaatttgtgtgacagcttaaatgtaaataggacacatctgcatgggttaaaaaaatagctgctcgttgtaaagggcagtgcactgtgtttatttatcatctacaactggaaagcaggttctgtttctagtctgtaatagctgatggtttgcgacaacctgaggcattctggaacagttttagttgactattgacttttgacattagtctacattcattttattttattttttttcccccaactacttggctgggagaagagagtgagcacctataaaggtggacatttacagaccaggtccttgaggcacacacacctgaccagatgcctgctgtctgctggtgatcacatacctcttcctaactctactaaccactatttgctgggcaggtacttcatgccaggtaagggcttcatatgcattctctcttttgctcctgtcaaccacccaaagaagtgcacgttggccgggtgaggtggctcatgcctgtaatcccagcactttgggaggccgaggcaggtggatcataaggtcatgagttcgagaccaacctggccaacatagtgaaaccccatctctcttaaaaatataaaaaaagtagctgggcgtgatggcaggtgcctgtaatctcctgaggcaggagaatcgtttgaacccgggaggcagaggtcgaagtgagccaagatcacgccattgccctccagcccgggcgacaatgcaagactctgtctcaaaaaaaaaaaaaaaaaaaaaaaaccaatacatgttattgttctgttttgagaaatgtagaaactgaggcacagacagttgagcgcactgactgtgtactgaaaagtatcagaattggtgtctgagttcatggcttagattattcttaaccatctatatagtatctttcagaagtctcacactcatctaccaagttgggctgccagtcaagggacacacacaagcctcaaactaaatcttggtggtaggtgaaggaattcattcaagaaaaataactcacatatagaagtgacatctttagttttattcagacagcccaatatctctcttgaatttcattacaccatacatatatattttatgtgtgtaagtgcatattcaaaatcatcatttctgtaatcacttttttcatgaatttttccatagttcactttaattctattgcattcaacaggtaagataataaaagattactcttacttgcaatagtgatcacagcaacaactgcaaacaccataggctggcaatttggaaagcaatctgagaagtcacctcaaaaattttaacaaagtattataatctatcaaaagagcaccacaaagcaatgacagattataccgatgtggaaagaagtccacaatacacaaagtgcaaaagagggagttgtggaataatttgtatagaacaatctcaaacctggtaaaagtgtgtgtgtgtgtgtgtgtgtgtgtgtgtgtgtgtgtgtgtgtgtgtgtaagcctggaagaatctctggaatgacagagtgcatagatgtggggatgttgcagaagggactttcacttttcactatatgcatcttctagactgtttaactttttatgcatatgcatttttaatttaaaaagtgataaaaatgacatttaaaagtgttcccagccagctgtcccaggcagtccaagtcactattggtgcgctctctatggtgattactgccatcaaggccatatttgttcctcagatcatctacctgctggccccagctctttcttggaatgcccgctccatctcatggctggctaagccagctaaaccatgcccagctgattttgagctatctagttctccctcctcttcctcctcattcctggttacatattgtcatgcccttgctctttgcatccaagaaggcccagatagctgggaaaacagtttgcactccagaaaaggatgctgaactcagccttcttgatgaggaaggcttgccccaacccagctggtaaagaggagatcaaaagaaacacacaggtctcagctcctcagctaagtcatcctccaaacttgattcctctttcattccaggctgtctagcagggccacccatgctaagcatgaacaccagcaaactgtatcacctcacatgctcagcatttcagaaggtgcactgtctgtcctatcagcaggacacaaatccagtgttgggtggtagcacctgccaatcaaatggcttttctgtgtgtacttctcctgagctttgaggatgtggtttccagtctgactttcttgtttcagagctgaagtttcaagcatgcatctggacaaaatatgctttccatataggccaacaatttatttatttattgcttatgacattgtacttggcagctaaggagatataaaacaatttgaaccactctgcagaaaacggttgcagagttgccactggagactgcggtggaagataacagaggagaatggagtctcgcagatctttctgtaattgacaggcagagcctctagaggcaagcgcggccagcagacattcctgcaaggagctcacatctctttccagcctcaactcctgctttggcacgagaaggagaccggaggcatgtgttggaagcctcctctgacaggacagatggagccagtatgaggacctttgccatccatccctaattgccaggttagatggatgttttggacatttattaatgcagtgggtggtggtgacctgcttccttcctctgcctgtctctcattgacactgtgggtgccccttccatggcctgctaggctcgaccatttcagtgtatgcagcccaacctctaactgcccattcttgcatgcctttgcctgagggcttccctggcctctaaggctcaccctatacaggcctgtggcaggtgaggagtgtgagggtattgatgccccttggagcagccctcggccgatgaccgtcaggaatgaagacacacatatcacagctccctcacccctaaagtgggatgactcaggttccacactagcctccagcattccacagcaggactaagctgcagtcaccagttgcccacagtggtggcttgacaactccccctttattggcttgccttcccattgccttattgatgtttcctgggaacacatcccccaaggacagcttgtactacatccttgtcatgtagtacaaagaagagtctgcttccaggaacccaaactcagaaaactcctacctatttctgcccagcccttagattatggatcaaaattagaggagccccaagattgtttcctgcacttgggctggttgttgggcctgcagagtgtttaaaagaattgaaataagttgctatcataaataaatctagattcttggattctattgaaaaatggcacagatatggctatactgagcttgcattcccttatggcatgtggggctgaagctgacttgtgatgcccctctaaccaagcctccctggcccatttccctcattgacatttccagactggaccctatggatagttgctgggtcagccaggccacctataaggccaggtgccttctttctccaagactccctgccttcctgagggtctgagtcactgtatggaacactcaggcctagatcatacatagaaaagtatgtggatagggatgtgtgttcatcccaggatgcaaaaatatcagcaagaagagagccactaacagctaatgagtgcaaccacgtcaggtgccctgctaaaccctttgcattcttttcttttccattttagtcttctagccactctgggaggcagatcctattattttcttcatgttttatctgaggaaactgagccttaaagagttggaaaacttatccacttagctagtaatgaagctgggactccagtttaaatttgtggtgttctttctgtctgcaaagctgcttggcccctctcatccagggcacaggtatatccatggaatgcactttatttatttatttatttatttatttttctgagttttgatttaaagaattttttttagaagaaaaagtctcactctgtcacccaggctgaaatgcagtggtgcaatcatagctcatgcagccttgaactcctggtctcaagtgatcttcctgcctcagccttctgagtagcttggactacaggagtacacccccacttccaactattttttttgttttgtttttactttttattttttgtagagctgggagtctcactatgttgcccaggctagtcttgaactcctggctcaagtaatcctcccaccttggcctcacaaagcattgggattaacaagcatgagccaccattcctggtggagaatgcactttacatggtagctatgccatcacccaggcctggccttgagtccgggaggctctgaaaccttccttgtcaggccacagaagaagtacatctccaaaaaggcagcctccagagtagccagctcctgtctccttagcattacaaaatagagaccttgtgattatcttataaggagaactctgaaagatgtatagaccaaaagattcattagcttctgaccaactcagtctcttcttgtaggaagtcacaggggaaaccaagttagactccgaaggccagctgaatttacaatgatatgaaactatcactgcagaacctggaatgtccaactgtggcaagcacagtccccttcccatagacacggcctctagggaagaagaggcctagaaataattttaaaagagagtagaaggggtcacgatgaagagaagaatggcatcctcaaaactagggatgttggttgaagtagtcatgtaagggcatcaggctaagaggccctggggaactattccacagcaggatggtggctttgatggaaagagtgactgctggattcctggccccaccttccctctcatctccccctagagatggcctggccactgggaagctccgtggctatgacacccatctcctggatagtggtatgaagggcatccccaagatcctcctctttcactcccccgcttttgcctccatggttggctgacacctctcctgacataccctttttcattttgtttttttttttgctgtcaatacattcaggcagctagatctagcctggctggctggaagctgtcctggctctgtaaggcaacttggcagatctctactccgatctattccattttgctttcttgggtgtacagtcttatttcccttacttccaagtccttgagatgggaggaagtaacctcttttgcctgccagtgtgtagacgataactcacatcctctgtcactattattactatattagacatatttctttttttctttcttttttgagacagggtctcactctgtcgcctaggctggaatgcagtggcatgatctcaactcactggaatctctgcttcctgggctcaggtaattctcccacctcagcctcctaagtagctgggactacaagcacacaccaccatgcccggctaatttttgtattttttgaaaatagagagaggattttgccatgtttcccaggctggccttcaactcctaggctcaagcaatcctcccaccttggcctcgcaaagtgttgggattacaggtgtaagccaccgcacccacccctggatgtatttcttaacttctctggtctaggtttctttccctgtaaagtgtagataacaatttttaattaaaggatgtgctcaaagggtgaaatgaaataatgtgtgtaaagtgctgaggagtgtctgaaatgtctaataaatggaataataacaatactggcaatggctgtgattgtagcacacctcctgtgctccctggagctctgaggtatagctcccaccgtggatcttaacaaatgcttgctaaattgacttgagccaggactcaataagggatgcaatttctattcatctggcctcaaactgacttatggaaaaaggcatttattagttcttgtaactaaatcattcaggactagtctggctttgggcacaggtgaattcgggatcttaaatgatgtcttcagggatctgtctctgcctctctctccatcattcttgtctactttccttttccttctgacttcattttcaggtagggttctcttctcactatggccctgtcgctcccggtaccccaaatttcatcactccagcttctatttccatagagtaaacagttctttttccaagcaatcttaactcaaaatttcagaactgagactcattggtctagtttgattatgtgcccatttctgaaccaatcactgtggcctaagggatagctccctctgagtgaccaagtctagggaaagtgaactctgattggctggcttgagtcatgtgcccatattgacatagtgctgggtgaagggtaactgtcccagaactgcaaaaactgaaaggaattccccagagaaacttggcccctggtatcaaaagatagggagacagacactgggcagaccaaagcaatggatggctgtacaccattagcaggcattaaatgcattttgcacacttgctcatgaatatctccctctccctgttgcagagccacataatcagaagactgaaggaccattgctgtgcaagtgaatctgagtagttctgacttgccagcctgtgacagggaaatagcagccacagatgtttaactaagcaagtactaccaggccccaggcccacaagctcttccccaagcccagtcccagctgacaggcaggcgtgacaggacatgtcaaggccaagagtcaggacacctgtcaagatgtcacagtgcctcaggacacgtgggttgggcaggtgacagctgcagtgaaccttcccgaggcccacagagcaacctgcatctgccaccttcaacaggcaaggcatctttcttctcagaaaacaaggaaagcaagcaagcatttgaaactgtatatcctttcctgtttcattaaggggttgggctttgttttcctgaaagcttttgttcttctgtcagcatattcaaaacaaccaaaaggcgttacctgctctgaaatccctgagatgcctatcctcagaggtgcttttggctgtcttatgcagcagaaggaagatttgcttcctagctgattctccagtcctcaggacattcacaaatggcaaattataagcccgtgttgcctctgctgactgcaacttgggcctgtcagcccagaataatatttgcatgatgatttggccaaatcaggcctggctgtctgtcatcctgggctcccttctctccctccaccagacgaacaaaccccgtggcccctcctcctcagatagctctggaatcccgctgcttttccccatccctgatctccccacccttcctttctaccccctaccacctctctcaggtcccaatagtctctgtgctccactcactcccctccatcaattcttggctcttccaccagaggggtccttctaaagcacccacatccgtccatgccactgctcagccttttctttcaatggtttccaagtccccttataattaagttcaatctcttcaaaaaactagcagaaaggctttctgacctcagtctcaaccgatagcctgtttgcctcctatactccagatgtatttatggacataggtaggctcccagatcagatctacatcatgacatcccctggggctgggctattctcctctgccgcctctgtacctggccaactcctacttatccgtgaggccacagctcaagggtcactacttctggcttctgaatctcggtatggcgtctctcccatatttgctctaggcatctagtgcctcctccactacagcacttattatactatcctgaaattgcttgcttttctgtgcttccttcattagcctggagtaatggagcctggaagatctatgagtatggaactcaccttattcattactgcatcattagcttctcatgcaaaccccatcacattatggaagctcagttcatatttgttaaatgtctgaacaatgtgaatgttcatactcagactttccattggctgaatttgaggtcacaatttctgtacatgcaactgagagcaaattggcacatcaacccgcacccccacctccagataaaatgtaagcaatagcatttgttccacctgatattccttttggctcctgatctttatgtccaagttataaaaatgtctccatcacaacttccacccctggaattgagtgcctggtgcagggaaggggcacaatctttgacacaatctagagcaagtgagacctccaaggatttgaagagaaatgtaagagtgtgctctgagctttggcttgcagaacctggggggtggggcgggggtggcgtgggagtctcctatttccttgaccatccaaatttgattttttttctccttgctcagcacctagtggtgtagtattccaagggcattaaaacaaggttaaagggctttatgtgatgaaaggcattcttagttgtgagtgtttagcaggagtttaaatatcagcaattttgtatatggaaacatattagcttcatatttaattggggtcgtggtgcactgtgaagtacagcacttatgtgcacagacttgggtatgatgtcccacagacatgggtttgagtcccagccctgccattaataagccatgtgacacctgcccaggtagctaacctctgtgagcctcaatcaggtccctcacctataaaacagggataataacaataaaagcataaatccttgtagggctgttgtgaagaacaaggtaagaaatgcacataaagtaccgtgcacagcacctaaaatgaggtaagcacctagaaaatgcaagctggtcttcttcatattataacattgggcccttaccctgctccagttgctagaaagtaaaaaatgcaccagcttgtcctgtgggccaagtctcacacacagatgttggttcaactcgtctgtgcattagttttctactgctatcctaacacattaccacacacttagtgactttaaaaaatatctatttattatctcacagttccgtaggtcagaattttggcacaacacggctcagttcattctctgctgagtttcatgaggccaaaatcaccaggtgtcaacagggctgcaatcttttttgcagctctgaggctgaatttactttccagctcattcaggtcactggcagaattcagctccgtctggttgtgggactttcctggctggcagttggctaagcatcattctcagcttctagaggccacctgcaatccctggctcatagcccctttccttttatcacagcctcgtctctcctctcctcccccttgggacctctctgcctcttctgctgcctaatctctccccttccctcttccactgcaccactctgactcttagactttctttctcgacttttaagggctaatgtcatgacattgggtccgtttacataatccaggatactctctctattttaagataagctgcaaagtcccttcgtccagtacctggttagtgtttgaataaagcatgggcatcttggaaaggcatctttagattctgcctatcacatcttatttgctgcattttaaaatctgaaacaaaacacatctcaacacagcacagtcattacgtgtttagtttgggctatttgtggagttggcttagctgagaagaaaaacgtgaaaaggttatttaaaaaaaaaaagtgggcccacctcctttcctgggagactaatgctttgttaaatatggacttttcaatccatttatcagggaaattcccttagattttccctttttcactttctgtttaataaagtccataccattttagggtatttaagaatttaaatattgcaaagctaaggtttttatatatgaagctgaactccagatttcaaactgtcagccagcagggtctgaacagggaggactcttgggggcaatcctgcattaacacaaacaggacagcgtgggctgggaaactcaagactcagattggaatgtatttgccaattggcaaccaatcctgttcttatcagcttatcagatttatttcatgtagaaaattaaaattctgggtctctattgtgcagaaatacttgcacatacgcccaaaggcatatacacaaaattatttactgcagtcttgtttgtgatagcaaaacatggcaaactatctaaatgcccattaactgtgagtggctaaaataaaccttggcaggggaattccatgaaatacttctgtcgctattagaaaataaggtaggtctatatatattgaaacggaaagtttaccaagacatactgttaagtgaaaaatgcaaatcacagaagaagctgaataatataatctaatttgtgttaaatgaattatgtgtgcattatttgtaaatgcagacaaaggacatatctaccaattaattggggtctattgcttctggggagaagtgtagagttgggggacagagtgaaggagacattcaggttttaagttgtctacttcaatatagcttaaatattttataatgagaattgagtcatgaatgtagattattttaaagaattgggtgaaaaataccatgttagacatattactaagggtaggggcatataggttatctatcaatgggacttgaaatatgatgttatttgatgtttcagaaattaaggccggccaaacagctaaaatgactaacctctgagcaattcagcttaaattccatgcttattcattgctacagtagagccaagtcctgatgagacatgctgaatgagagagggctatttaacttctagtttctggatggctgtgaccttccacagacctcgcacatagaaggtactcaataaatacttgaataataaaacaaatggcactattaaatttgggaaaagtctggtatctgcctttgattaaataaatcaagcctactaaaatcacaggagacatatatacaagattcaacccactgtcaagaatggatgaacggaagggagatggtttccattacagaatacaggcaagtaagatttggaattagacaatcgttctttactttcaaacagaaccaaacaaaaaaattccccaaaaaacagaccttaaaaactaaatcctaaccctacacagcccctggaataaagcttttccaatgtacctgccagagcagccagtagaggagaaaggggctcggaggaggaggaacttgctgtctgcagcgctgccccttcatcagtgaagtggggctagaatcgatgatggctaagctccctttcagtgccaactttctggcaatctgtaagtggccactctggttgcccagtatcctcaaaggagctagaatcagttctttcagcttcaaagaaacagacccttgggtttgcatgtcaaatgtcattgtaaacctatgccccagcccccacctcgtctgcagatcacctatcagggttgagctgcaggaggaattacagtggccccttcctttcggagggcaagttggaaagggaggcagaatgtggcaaaatgccttcttcaaggccctcaacattaaactttgcattgtttttagctctttaaaaaaatctttttttacttttatagttctaaatttactttggatttaccaatattaactaagtggctaagtaaataaatatataaagcaaacatgagtaccacactgtcccccaggactctaagcctaggaatgcaaggaaccctgtttctaaccatgtacacacactctttgctgctattggtttgtctctgcctatagccaagtcacattttgcagtgcgactattctgtaaactacgcgcttgtttgtaaattgtaccagatgctcagccactaactcagccttatactttcatcaggtttttatgtctttatgatgtacatctttgccactcaaagggtggttcacacaccagcagcattaacattgcctgggagaagagttgccagataaaatataggaaattcaaattttactggatgtcaagccttttatttttttcccccctctaaatctgataaccctacctgggagtctgttagaaacgtaaaatctcaggctccacccagacctaatggaatcagaatctgtatttaacaagtttataggtggttgcaaaatcgacttgagtctacttaattcctgtgatacaaaccttctaagttccactggcaaattctgatctcactctgcatcaaatgtagatgaaaagagtaagctgtcaacaagcttggtttctgtgttttccccatttcgtcatacattctgttcgcaaatgcgcacatttttcaacctgggcacagagggcacccccactttcaaccactcctgagcccgagctcacgaaccgccatcgctgcagaggagacgccaggcggtgttaattgcttgctgggtggtggggaggaggggctgggttaccatctcgcctttgatcaggaggtagaagtaatggttttacttacatcctgctttgtctctgcacaggctgagagccaaggatccatttcaggctctctctttcttcctagtattctgttactgcctacataccgcggcccagagcttcaggcgaggttgtggggaaaccaaacgctctttgtggtacacccacatgacaggcttcaaaatggaaacaatatttaagtttaacctggaagatcaagtttgctcaaatctcgcaacgcagggagcttttgaaaactttagcagtaggtctgcatttgatggagagaggcaagcagtgatggagaaatgaggccttgttaacagacactgaatccccacacgggagtcaacatttcgccttattccttataaataatggggataataataacacactgagacagagccttgaaagcttcaaggtgtctttacagccacattcttctgcagtctgcagaataattttgggaagagggtgcgcggtgaaggtgtagaaggtagccgtcatcagccccacaggacagagaagacacataatcaagtaaactgattttaaaagtcaaaaaaatcaagacactttcctcaagtagcacatttcctgactcttcaagcagcgctctttccactgttctcagggttccattatttggttgccccaagctactcagatctcagccattccgcaaggaatttcagggctggaagaaacctttaaatgattcatagaatcttgttatggattgagttgtgccccctcagaattcatgtgttgaaatcctaatccctagtacttgagaatgtgaccttatttgaaaacagggttgttgcagatctcatttgttaagatgaggtcatcttggatcctgatcttaggtgactgttgtccttataagaaggggaaatttggacacaaggagacacatgcactcaacaacgccgggagaaaatgaagacagagatcagagtgatgcatctacaagccaaggaacaccagagattgccaccaaaccaccagaaactaaaggagaggcatggaatagattgtccctcacagccccagaaggaagtgcgcctgcctacaccttgaacaaagcctgcagaaccttgttatggcagccctagaaaggaaagacaaatcataaggtgggaagtgtcatcatggtgctaatgctgatgagagtttgctgggctccagaactgggcaagggttcactgcatcatctcatagcttccatacatggactctgctaggtaggcactagaaatgagggctttgaggctcacagaggctgagctactcagtcaagatcacacagctagcatgtggccaagatggatttagacttgggcagtctgagtccagactctgttgcattatcccttaaacatcacagcctcaggtggggtggccaggacaactgattagcatctatgaagccctttctcatgtagaacctgtaaggggctcacaccaccaccatgaggtagacactattgcctaggttttgtaggggaggaaacaggcactcagattaaatcactgacccaaggtcacagagctcatcagcggtggagcggggatttgaatcaagtctgttgactccagcaggagctctcaatcactgcgcaggagaccagcaagttcagatttgctgggttctcagtggcaagtatgtcaccctttccaaatcaccatctcctccctctgtacctccacctgccatgcacaccttgactgttggtcccctcttccatgtcgtaacacacacatggacattttcaatgttcacttcccttccctccctctgtgagaaagctctgcttcctctgagtagtgtcaaaggtaactttcagactgtaaagtctgtgaggttccttcagtctgcgggtcaaactctgataatgttcaaagtcaaatccaggaatgacatgtaggggaaaagcagtggttcccaaccaaccaggagccatgttgccccccaggggacattcagcaatctctggaatcatttttggttgttacaactaggggctgggggtggggtggcagggatgctattggcatccagtaggtagaggccagggacgctgctaagtatcctacaacagacaggatgcaagacaaagaagtatccagccctagattcaatagtgctgaagctgagaaatcctggcatagagcgtgttctccagaggcaaactgcccacttctcaattccagctccatcactcactagttccgcaacttggaggcaactttcgtaaactctctagggtccagttttcttctctttaacatgtaactaataatagcacacgcctattaatatacataatattagttattatgtaacgaataatagcacataccaatatcttatatgtatacattattacataacacatgttgtatattatatgttaaacattgtgttagtttcccaggctaatccacaaaaacctatatcatgttgtcatgttgctaaaattcctatgcttgtggagagggttggggaggataatggaagataatataacagctaaaacataatacgaaaaacaatactgaatgaaaacttaacagcattgattgatctcagggccacatacttcaggagaagtggccttgtttagaaagaacaagggaagatagtgctcatcttatgatgctgttttgagaattaaatctgttaaaccatgtaaaccgtctagcacattgtaaaagtgatgtaaatgctagttgcatagataaatggagacctttaaaaagattccagagggaatttctgaactcttttaaagtgaaacctttagagagtgatcgcctaaattatttatacttaatttcactttaaaacaagagtttccttctacattgcacctggctatttgtgcacatgctaagtgcctgagtctgccattcatcatcctgagactgcatgctgcagctaagattgccagctagtgcagctgagaatcagctatggaagccccacagtcagatgcttaccttccagttttggaaataataagggtgcctctcctaagcaattacaccgtgcccagcacttcacttagtgcctggccatacactaactcactttgccccccaacaaatccaggaggcgtgtgctattattagttacatgttaaagagaagaaaactggaccctagagagtttacgaaagttgcctccaagttgcagaactagtgagtgatggagctggaattgagaagtgggcagtttgcccctggagaacatgctctatgccaggatttctcagcttcagcactattgaatctagggctggatacttctttgtcttgcatcctgtctgttgtaggatacttagcagagtccctggcctctacctactggatgccaatagcatccctgccaccccacccccagcccctagttgtgacaaccaaaaatgattccagagattgctgaatgcataataaattatatatctctctcactatatacatataagatatataatgcataataaattttatatatatatatgtatctcactatttgatttcccaaccatgagttagctggctcataaactcatctggggagagactttggcatgtggtttaaggagctgggtctgaataaccccttgctatatcagatagctagcggtggccacataatactgaacaaagaacacggaatgtgatggggaatgacaactgggttacagtctgggttcttctacctctgagttgtgtgaccaagatgtaatttagcctctcctctgtaaaatggggcaacctaagacccacatggtggggcagagaaagactaagtagagttacacatggacaaaggaagccttccttaacggttgtgctccactccaggacaagttatgctcatcgtcatgacttggattccatggctacaagtctcacaggactccattggggtctgccggctgatgacaacacctcattccaatgtggtagtatcactttcctatcttctttttagtgcctttgtgtgttgcccctcttgacctctgggactggtgttcaggccacaccacacagctctcaatgccagcctgttgaatcgcccatgctaatctatatctatacagaattgatggcaattatagattatgcaatataaagttaccctgtgctaacctccagagtccttgaattcttcttatgaccagaacctcacattgagagatgagtaagaatatacttaacttgagtaaaactactcaaggagagcaggaacttgaatatttagcttctgttgaggtgcacatagcaggtactcaataaatatttattgaactaactgctaaacaggtaagtattagttaagtgctacatagcatagtatgcaacggttatccctcccagtgtcttctttcatttcttttcaaataatctgaataatttgtaggcaggagcacaagagcttagtttttcatcttatcaacaaagaaccctccaaagaggagacattcctttggccttggttgttggcatttcaggtataattatatttttcaccctaaaatttcccaacaagattaagagttacacacaaagtctccttaacctttggctcggaagtttgcacaaggagctctgcccacttttcatgtgatttctgaaagatgccagctgctggcagccatgaaacatgaaacacaaagaacccataatctgctagaacataccctgcttgcacaattccttgaagcctctctaagaatacaccaaagcctgcaagtgtgtacatgcttttctccaggcaaggaagatgcaacattgctttctcaacaagctgtttccaatattttaagtaactattctggctcggccaagataagagagtacaaagatctagggaaaagacaactttcacattttctttgtaatttcacttggttgtggcctctgttgaagtttcccctacttcaaaacatgattgtatttcttgtaatggctgaaaagttttaagcttcttcatgtacctaattccaatgggctattaactgggctagtttattggcactgtggatggagggcttttgaacttgcaggcatatattttttattggctggacagtttgcttgactcttcgagagctatatccaacccatcccagccaggtggtttttggtgcatagcatgaagtctccagggagaatggttccatttgttcccttggccgtgtgtgccaatgcaaagcccagcactcaatgctcaacctgattcaggagacatggagcaagtaaacttttaaagctttataacacatagtagatacttgataaataattacagagatattgacgtggcaagcctgtgagaggtgatcaatgtagagtaggtagtggtagggaagaaaataaaaacaacaaggctagtatttatggagtgccttactatgtactagcactgagctcgcattttacaccactattacgtttgatcttcacaagaactccatgagggaggaaaatgtaagaaatcgctttccccattttccagatgaggacattggaaattcagagagattaaatattgtgcccaaggtcacacagctttcagggacagatctggaatgcagagctcacactcttaccccatgagatcctatatgcagactggacattctactcatgaaaaaagggaagaacaaaaggaggaagaggtggtgaaataagatgtgagaagaaagcagagaagtggtcaatggagaaaacccctaaggtggagaggatgaaaatggacagagcccttgttggctgtcttcacgattcttaaagaaatgggcccatcttccccttcccatgaggggagtttgttggggagcttgaagactacagcagagattgaaaagggtcaccatggggaatgcaatgtgagtcagtgcagacaagcaaccgccctgcagctctggagtcagacatacctgggttcggatcctagctctgagattttggagctttgtgactttgggcaaagagctttccctctctgtgtctgaatttcctcatcttgaagacaggatcatagtggtacataccacatacggagacatcaggatgaacaagatgaccaatgtgaaagcacttagaatggggtggcaaataatggcccaataggtcaaattcagctagccactggtttttgtgtggtctgcaagtcgaaaatgggttttacctttttcaacagttgggggggaatttttttaaaacgaatattttgtgacacatggaaatgatatgaaattcaaatttcactgtccataaatatagtttacagtggaacacagccatgcccactcgtatggtctctggctgcttttgcatggcaatggcagggttatggagttgcagccaagaccacacgtggcacactcatggctttgcactgctgttcacacactacaaatggcagcaaggttgctctaacttgaccagactttgagtgtcatgcatatcacctatctgtatggacagatatttttaaagatgaaatacataaaataccattacagatcatcattaacagatgaacatttgcaatatattttgataacagagaatactaattttgatccccaataaagtgacatgttatcccctaaaagaaacccactctcttctcattagtagaggtatattacaaaaaattatactcattatattttgaatttcttcaataaaaaaatctatgaacatttgttttctttcttgttatataaacatctatatctggattttgcccacagattttggaccacaaaacctaaaatatttactatctggacattgcaaagttttctagtaagccctaacttgggacagtggtgggcacgtggtcatcggcacaggagaggaaatgctagcctctcctttgccgacatcctttgagaaaggccccaagttcctttttatttgtctcagtcttcttgaacagtgaatatatatgcccattaagctccacataagtaagcacttggcaaaacatagttgccaaacatagaaaaagaaaagcctaatggtggtgctaggctatcggccttctccttttcaggccaattcatcatttttggcatgcggttgtccaggcttcgtgttaaccacctcagtcagtggtggtagctccacctgcttggaaaatggctcatcctatagtccaagagaagtcaggctgcagcaaaactttccccagatatattctgtgcaccctaattctacatgagggtgtgagaagaaaaggggctgtgagcaataagcacagcaaacgctgtctctctggagtgtgacagctgactggaggaccctggcctattgaaggctctgagaaggcctgcagtggagaaacctattaatgctgtttaatccagctttgctcaaacttatttgaacaccatatgcctttatgactattttttaaaatagtggccaggtcgggtagctcattcctgtaatctcagcaccttgggagctgaggtggatcacctgagtccagaagtttgagaccaacctggacaacatggcaagatgccatctctaggccccccacccctacacaaatagccaagtatggtggtgtgtgcctcctagctacatgggaggctgatgtggaggatctcgcttgaacccacaagtctgagactgccgagagccatgatcacaccattgcactccagcctcggtgacagaggaggaccctatctcaaaaaaaaaaaaaaaaaagtcttttaatatccaacaccatcagtgcactgaggaacaccttagggaattactactatagtggaaggagtagctggccaagagtcacatgtttgaagttcacgtactagttcccctgtgtctcatctgtatagccctggacaaacctccttttcttactctataaaatgggcatggtgtcacctgtctgccctcctcgtagagctgatgggagatcagatgaaaatcagggacacagggcattttctctaaactggcaagggtgctatgtgagtgagacagaagtagaagaaatggcagtgtcagctcttggaactttaaggtgttttccctaagatgagtgaactaggcagaaagccactgtgctgaaggccccctcagtgtttgtcaggacagcagtgacctacagaggggcaaacgccagagtccatccttccctgtccccagtccctgccatggaaatgcaacccagctacataaagctcctgcaggcttcggggcgtaggagtctcttgcatggagtcaggccctcacatgaaaaaatggctcaacagtccgggctccatcagcatgttggtgcattcataatttttaaaaataataacatggagaaaattcatctggtgcatcttagctggcaccctcacacatcgtcacctccttatctgatatattagatttccctgtgtcccaagcctgttatataatgagggacaaagattgctctctggctctagaagacttcctcattctccctttctcattccacattccgtgagggggaaggacaattctttgcagtggccaattgtactgagcccaaatcatgtttcggatcagctgggggaaacactgttagccctgcaagcccttcctctctgagaagaaaacaggcttgccatgagtttcccaatgtgtcacctgccttcagacaaaggggagcagaggccgggcacggtggcttacgcctgtaatcccagcactttgggaggccgaggtgggcagatcacgaggtcgagagattgagaccatcctggccaacatggtgaaaccccgtctctactaaaaatacaaaaactagctgggcatggtggcgcacgcctgtactcccagctactcgggaggctgaggcaggagaatcacttgaacctgggagacggaggttgcagtcagccaagatcacaccactgcactctagcccggtgacaaagcaagactccgtctcaaaaaaataaaaaataaaaaaaaagaggagcagagaggtttcttcgataacatgatttttatcatgctcccaagctagtgccccagcaccaggggagacaagtacaaaaaaataagtaaaaccacaaacccaacacaaaacagcagccagagtcccacacactgaatccgtttacaatccagtgccgtgggccaatggggagactccctttttaattaccaagtttttttttttttttttttttttagtagagtgatttgtacagaaactcctttcaaataacacagtgacttcagggatcaaggtgcacagaaagaagaacagcagaggctgggggatcagcaaggttgctaattccatcacacgctgactcagggcaatcagaggcactcctctgacacgtgagcagggaacaatgaagcctcatgccactgccaagaacaaacccaatgggcaacagtgtactcttcccagcctctgcatccaaagggctctagtgtgcgtggccactccagcctgccctgacctcccgactgcccgatgcagagcatatcttaaaattataaacagatgtgaaaaacagtcatgtaatgccaagtaaatgataacaccaccaaaaacagtcttagctacctttaaaggcttaatccatcaggtgggagtggtggaaccagtatttgaacttggtctgtgaggctctagagcctgggtactgcccaaccactctgcgccaaagattatgcaaagacagagattcccatctccatcaagtacatatttacaagaccatctgcataggaaaaatatggcaagatatatactgaaaagttaaaaatgatgctttctctgaatgaggattttgagaaaatttttttcctgatatacttattaaatttcctaagttttgtaaaatgagcataaaagtaatacatgaggaaaatgaattggtggctgtaggaagctcagatttcccagtgaaagcaatctgcgattattatttcagggcctcgtcttatgtttgccctctgatggacaaagatacaatgtgcagcgaggggtctttcgccacatatgggagtctgcctttttattctggatctaataggtttaactgagaaatcttctctcgaagagattataacaatctttcttcttcaaacttccaggggctctgtttctacctctctgcatatacacagtgactgaggaactaaggaaatgtttggggactggcagattttaaagctacccttgcccttcaaccacccacacaaacctaaaagaagggacctgatttattaaggtgcacagcagaagggcacacggtgaggttgcaaacgctgactcttaggctgaaagaaatggcaaggagtctccttataaaggctcagcatctcagtgattttgtcaccatgggaacaaccctgtgagctgcaaggcatgcatggacccatgtttacaagtgcaggatctgcttcagagggatgggggcctgacatcccaattttactccactcaagattgaacacacgagcaccttagatcctgacctggcacagtggaagttctcagttgctgtgtgctgttgttctcagcatttacattatatttcccagaaaacaaagctagaggacatgtatattcccagaatacattcccatctcaaagtctctgacaaacatgttcatggggaagccacaatgagggttgcagtaagagtttcataagaacaccaggtagccaccagatggtggactagcaattttcctgcagagatcatgtgactctggagaaggaatatatgggggaggcctgaggacagagttaaggtacgtcttggtaaggctaatgacctccagccaatggatgctccaatagcagaaaggaatctagccattctgattgatacacctagtggtggccataatatgtgctctgattttagatgtcgtcttggttttcccctttggttggggctgtggagatggttggaaagaggtggggctggagttgctttccctgaaccaacaagacaattctgactcagagcattacgttggccaccaattggatggctccccaaagaggcctctgagaagtatctattctcaggctacaagtctcaaaatgaaacctgtgagccttctcaaccccacatttgcatgttctagagcaataccttctggtctccctgaaagtgccattatggccattttcaaatgttattaataattcttttagaagctttggttctgcctccaacattaaatgatgccctgcatcgtttaaaaaccctttccatctttctttctcttttctttcttttttttttttttttttttttttttttttttttgagagagagtttcgctcttgtcgtccagactggagtgcaatggcacggtctctgctcactgcaacctctgcctcccaggttcaagcaattctcctgcctcagcttcccaggtagctgggaatacaggcatgtgccactacgcccaactaatttttttgcatttttagtagagacagggtttctccatgttggccaggctggtcttgaactcctgacctcaagtgatctgtccgccttggcctcccaaagtgcttggattacaggtgtgagccagcgtgcacagcctttctttccatctttctgataacttgggtgatcctctgagataaagcatgtataatattgtgatgtcccaggtgtaagacaattgtcacataagatcacgcatgtctctctggcacctgctaacactgacagtgctaactaccaaaggcacctctctccctactctcacccatagcagacttttgggctggctggtttcgctgacgtttactgagctgcttattattattattattattattattattattattattttagcattcagcttttcatatccctcccacccattggtatctgtgtctcagattaattttcaccagatgtgagtgtctggacttctccaagatttgttattttccctccatgttcctaaccttcttcaggccatttgtgtgatttctctgacctcaactagtgtttccaacaccttccaaattagtgtcatctgtgactttccttcacatgctcttttctcccctttacagatcattaataaagaggttaaacaagaccagaccaacagcatactctaaagcaaatgacaaaagggtgggagagccagcatgctccctgtgcgccagccctggcacaggaaggatgtaatgtaatgtaacaacactctgctagacgcctcccgcctctggcccagtggtaatttatcaccactgtttgtttatgatttctcagccagatttcaggtcctcagagtgtggtcatatctaagccaacatgcattgctctgccaggtaacccttatgagctccagagaaacccacaagaacttatttactgccctccaatctccttaaaagcttctaccttggcccccaagtccatcacccttgagagcagaaagaggtggactgagacattattatccttttctctcttccaattcattagctcgcaattaattatttgttaaatattcattggctttcatgttactcattagatttttctttaagccgaaagaaaccctctgctataaacagggactaattcatactctccaacaatcaaactttcctttgctatacccaagtgttataaaaatcaaaggtaactggagagggtatgtttatagggtaaacatgctttaagtaaggcctgctatgtaggtggcttgggtgtagctatggccataggaatagattacctttcttttgccttttcttttacctcccaaattcaacaaccccagtatcaaccactttcctctgtttatggatacagtacactttcctgagcccagaagtaacaataatagtgatatactgatattctacccagggttgaatactcactgtgcaccaggcatgacttggcatcttactcagctcatcacagccctgggggtgtcacaaccttcctcaaagagaaaatggaggggagagacggaaggtgacttacccacgatcatccaaacctaggtctatctgaatccagagaccacactgttagccaccccaccatagatgagggtcttcttcactttttctgagtcactggcccctctatctgctgaggaacataaataaatactctctttgtggggatgtgcatacatccacattgaagcctattaaccatgtcaggggatttgcagagcctccagggcttatggacgcctgcttgagaatctatgtactactctaagctcctcgagggtaggaatcacactttgttcactaccttgactcagtactgagatgtatatccagtacatctccagtactaagatgaagaaatattttttgaataaattactaattgcaaagactgtgaataggatattcaagttgaagctctaaacagcagctttgtaagcctgaatagaagatataaatatacagacaccttccagaggagtagaagagcaaaataaaaggaggaagtggggacagagataaagcaaaaacatcttactttgcccaggaatcgattttgcaattggaagtaggcagagacattgtcatggtggttctaaaacacctcgtagctacttctggttagttctcatattaactcctgaaaagagattattgaaagcttcttctgcagaaaaataatatacttagaatttcaagatgagaagtcaattatcaagagcaatcaaaatctcatgttgtaccccttaactgacagaattcttgatccctggagatctcagggggaactacaagagccaatggcaacttccttctctctaggtccctctagtccctaggtccctttcaacctcctacaactctggggtttttgtttttccacagattgctaccccttacatgtcttcttattctataactactgattttgctttgcaatctccttttcttcaagagttggaggagccacccactcttgaagttagacttcagacgtgctttaaacttgtcagcctgcacattactgcaataagaggccagagattcccctgctgatatgcaggaacatggaaaacagccaaggtcaaaagcctgcccttcccttggccagagcgactggacatctggggaaaccagaactctgagttccctctcagtgcccccaccaccaccaataatggcctgctccagctttgacacccaaggtagaaatctggaggcattctcaattttgtcctttgtcttacctccccatccaagtcctcctggcttcaccttcctagtcttatctccaatttatccacttgtctgcatctccactactgctgccctgggtcagtgccatcaattctctcacagatcatggaacagcctctacttctgctcttcctgccacgacaattcatcctctacacagcagccagggttgttctacaacataaatcaaatcatgtcatgtccctgcttaaactcctctgatgtctgctcagttttcttaggcttaaaatctaaactctctacctcgccataaaaggccctacgttttctggtcccttccttcttctccatcctcatctcactgttttgtgctctacccagagttatggtcttcaagcctcttcagcttataaactccttcccacctccagcttttgcatgcctcccgggaccacctcccaaatgcacgccttggcatggatacctcctgactctccccttttaagacttggcttaaaacttacttccttggagagatgcttgctgaacatccttccttaagtaggttcctcaagttaatctcagtatctttctggtttccatcaaagccatgaccaaaacgtgcaaggtttctattgagatgtctaattatttatattctgtcccttgactagatggcaagatccacaggggagcaaccatggcaatcttattcgtcactggtttcctagcatctaactgagaacttaaccgtttggtgaaagaatggacaaatgagtgaataataaatgaatgaatgaataaatgaaagtcttagtagccaatggcacaagaaagagatatatcagatcctcagttatacaaaatctaaattgcattaaaagcagcagtagctacccctgtacaggcggtgtgaaagaaaacctgcactttgcatagaaaccaccactttgtatagaaacctctgctttgtgtagagctcagagctctttccttgattttctttttgcagccattaaatttctctagttccaggacaagcacaggcctagtgtccagaccctgtccgctaaaagaaggcaagtcagacctgaacttcctagccacaataaaacatctccttcctccttctttcattcttccagaggggaggcatggcagggagttccactgggccatccagcactgcttttatttgtaaaacaccacttcctcgtgtctaaatgttctgggattcatatttttactcaccataacattgtccatgagctggtggcagacagctacaattcttcattttgaacaggctgcatctactagcatcacagcctcatgccaaaacttgttaatgccacatctgtatttttatgaatcgggtcctaaaaatttgcatatgttttcaatcaaaaaagactaattcctttctagtggtttaagaaataaaaacttgtgttctatctttgctcaattacaagagttcacagtaagagctcaaacattcaaatgtcgaggcagaggtggcactaaatctcacaaggtgcctcgatttgctcctccattgcctacctcattgatgttcgcaaacccgaatgcctcttgggggatccatggaaagcaccttcattcaatgtaaatgaagaagtatttgctgacacaaatgatacctacattaagtggattttcctgaagaacaattatggagaattgaggagctgctttttctgcattttgcaaggcaagatagggaatacagttaggcctccaagagcacattttcacaattgaaagtatgtgtgagtgtggggtttggggggttggtggtgagaggacagtggttgaatatgctttgccagggatgcctatgatggcaagaacttgctggaaaagtgatcccgtggagtctctagaagaaacccagaacaatgaggctggccacaggtaaatcttaggcataagaaaacaagagtgtggatgatccaacagggagggggagtataaagagaattgggaagcagaatataggaatatatgtttggtgtaggcagcatagactacataattagtggcgctgagggcaaatgaacatgtgaggccccttctttgaaaaacattaggaatttcaagacagtgacagcagagttttaacctaagagtgaagcccttccaagtgtagggcctgtggactgcacaggccatacgctgataaatccaggcctgggtgtgaggtttaagaggggaaaggctagctctagggggtgtcaaaactctttagaaaagtaaactttccccggtccaccgtgtgctcggaaaataccactcttgaatgaccatagtgagacaaataaatcatgtctggacttagcctccagaagtggcaaaaaagggaggagctgatggggttgttatgctaattccaatttgttgtaatttttagagtgactttttctaaattatgttcatttcagcaccaaaactccagattcaagtcagagccttccgatgctattatgagcatattactgatgtctagtaaaataacatcttgtgatgtttcttttataggggccataaatcaaaacattgaaaacagttaatttttaatgtaccactattatccatctttagttataaatttaatgtctcctaaggcctcatggattgtaatgcaactcaaaacatgcaacggctgctcaaaaacagaaggttcccccagtatctcattatttaaatccttaaagatatggttttaaaagcctgaggatatctaagcaaacttgtttaaaggagtcataaagaaagataagtagttttcctctgaagcatatgaaatttattacagcatactaaagtaggattatatattgactaaatttctaaaaacatttattttctggtgtgcatggcatttggggaaattcacgaagaaataaaggggatagggcttaatacaatcgtctgcatttgccttaagcaaagcaagatttcctacgggtcttggagccaattccatcctgaggataacaacactgttcatatctcagggtgtcatgaatcttgtgaaagagcaatacaaaatcttcactattcaggaggaaacacaagtgcagcctagcgccctgatactcatgatggcagaagtagcttcacagaagagccccaagtaggatctacacttttcaagacaactgccaaactcttagaactttcctttacctacctcttccatgcatgtttgaggcaggcttcatgtgtttgctttttaacgctataaaacgctttcttctcatttcatatgactttaggtcaattgccacttttattagcttttctctgtgagtaaatgtgacatttctcttaatattttccctacatagggagagagttgctcccatagacatccagaacttctctgatttccccacttcctcatactgacaagctttcctgcagaatgactttgcatctggaagtgttaattccagtgccgttttcccctttgccaagaaaagggagaagagatgagatacttctgtattaacatgaagcaggttttactggcagcaaatggatccaggaggcattacatctttactatgtagaaagatgtcgtacctgaaaaccaccatcctgtgaactgccccctcagtaccaaaaaaagcaaactgacccattagtgggacatgtaacaggttcaactaagaagtaaaacacaacaatgaaacgtcacccacaggccaaacgtaccagctcttggttaaacttcacctgaagcactacctgccatgctatttgaaggcaagactcggggaaagacatacatgctaagttatcccaaagaattgtcccacacctgttgaatctccagcactgtgtcatttcatgcttgtcccagaataaagagctatagattgaatactttctgatcagaaaaaaatcaccatggcacacaatcaaccacattccttgttctgaataaaacatcatatgcaatgttatcaagtttaataccatattccatgtaaccatgtgtatattcaactccagggagtttgtgacttggtgttaaacagcctgcagtatagaggagaggtgtaattcccagcagcaaaagttgctagacttcagtattccattcataaccatgtggtaattacatgtgtcactattcaatcgtaatgcagacaggatgtaaataaagggtggattctcaatagctaaagatcagcttttaaaatacaaaaccctctgataaatacaatgtgtataatttctaatgcaaagcctcatagaagtataatttttaaaaagcaacagataaaatgtcactaataagacctgctaatatgaatgtttctattctaattcatttaaagagttacagttacccattcaccattactatgccttgatccttgtgttttcttcagaactgccatagaagagatagcacaatccattaaacggccttcttagagatgatagtttcagctccatgaagatacatattttattttccttattccttgccaaacatttgacacaaccagaaggacgtgagagtcacaccacactggcatatctggtgaaagcaagcagtcggctgaaaaccacgactggagaattgcgacaatttctgagtccacaatcatgccttaaaaagtgtgtataaatcctagtaagggcacagtttacatcttaaataacacagaaacatttgaatcgtgctaaacccagccccaacaaggcagagcagtaatgtggttgtggggtggggaggtgaggtaggatggagggggctcttgggaagggtcagggcacgcggacattctgcgctcacagaacacagtagcaaacacagggcacaattcacaaacatcagcgagcacaatcgagcacgcacacaatacaacactagaatgcaattttttaataaaaatgatataaaagatggtttctcacccctcaaaacaaaactggaactttggtttacaggcccggctatgcccatatgccctcctcgtcatcctgcggccggcccgaggtggggaggtgcacagagaggaggggagcaccagaatgaaagaagagaaggttagttacaccgagatgcactggaaaggcacactaatcttcactttgttttttaatcttcaagactgaagaaaaaaatccatagtaacttaaattccacatcaccgacttgtcaaatacataaccgggttttgtatctatggcaacccacacacaaaaacattccacccacccagctctgagtctgtgtcaaaatcggattagaagattaaaattagtctacattagcagatgattatttttttggaaagcatgcaatctgaattgcatatgcctaaggagtagattaaaccttttaagtaagcagagaagtaattatagtaatcaaatacccttaatttctcttaagcttaaagtatcaataaaggctgaagaattaaaaacacacacacacacgcacacacacacacacacaactccatctactggggtggaacaaactttttcagcatgcgataattcatattggttattccacaaaggctcaaacatgctgcgatcttcttagttgacagattctattttgctctcagcatgaaagaggatgcactggcgatggtatgattatacagttgcatggaatgattatacatttgcaatcaaataagtttcaaagaaaagagaggtaaactttcaattcagtagaatgcttgtagaaagaaagttttgcttaacttaaaattgtgttcaattatggataaactgaaacttctttggttggaattcttgttgaaaagtgtttcgaaaatagctctggtgactttcctcacttagtgaagtggctaatatagagggaaatggaatctttgaagacagaagtatatccccaaagcaaagtcccttttttgaacaattctcacagtttactgcaaggattgaaacataccctggtgtcacacatagtttgagagctgtgccttttaataggtctccagtgaagtcagatttttccataatttgcttcttgttttgaaaatcaggaatagaagaaaaaaaataacctggaacattttctcattatttgactccttattggttaagttgttacactcttaggttgaatcctatgaaaatgccaatatttggccatttttacctagaaaaatagcagtttcatacagttccacctaatccggccaataggcctagtcatttttatctactcaaagatttatttttcaactgactttcaatacagtttatttcctttgtatttctatgtattttattttatgcattgaaaaaagtattctgagaagagatccagagagttcatcatactgccaaagggatccacggcccacgaaggttacaaatccctgactgacttgagtcaatggaatgatttgcacagagtctgaactggacaactcagtatgaattttcacttgacagcttaggtaggaatattctggcaaacaataaaacacattgatcattttagctgggccttcttatgtaaaaattatctgtgtttatttattattaaacagtctaataattgctcttgccaagaaacttcccttttccctatgtgacttaggaaaaatgtatttttacattcatttaacttcctctctgtccctggagaaaagaaactttgatgctccttttcatcttcatgaaggagggaagtttacaccatgagaccctaggccattcataaatgggtttcaaggggcctagcaaccccttgaaattcaatgaagaatgttgttgagtatgtgtgcaaatatatgtctctggatggaggccctagctttcatcatatgattcttgacccccagaatcgctgctgtagaaaaactccaagcatagaaggatgctatgatttgccaaagtcacaaagcaaaataggaggctttctctaaaacacagcctacggccactgccgacttcttcctaaatagctataaaataacttgcagagcagtttatttcatttcacatttaaaacccaacatatatacattcattttgttccaaatccattcctatcaggttttaatttttaaaagagaagaaagtaagcaaaaagaaaagccactgccaccaaaacctactactattttcttaacagtggaatgtggtctaatgcaaatcacttttagcaaattaaatatattaaaaagtggtaattaattatgattgaaacagacaggagttgtagtttgaaagtacacgctgccaatatcactactactgttcctcgtccaccataggaataaaaaggggctcccagatgtcgagggttattaaaaaccagatgttcagatcgacatcttgtatgctagtgaataaagtaaagaaatatgacagtccaatgtaaactttgctaacatttaatgtggcagaaatgtggataaattcctttcatgaactcagaatattatgcatttttaaaagtttttagttttttaaagtttaaagtttttaaaagaaaatagagaagtggtggctctttctggtctctctaaccttcaaagcttaaacatgaattgaccctcatcgccaaatgatctgggtcagagtgagtgtccgtttggggaataaaaaacaaaaatgcaggagctaatcagtgcgggagctccaagtctttccaaacatatgcagctgtttcactgctgcgctgcctgcatctctgtatgcaaatattaatttgttcagcaaccttactgcacagaaatgtaaatttggggacccaaaaataagaaacagacaagtatcacttgatccttaacttcatgctaagttgttgagaaatacttggcattttaaaatgcatctatcaggcctgggagagtctgtttcctttccttgtttttctgtttccaaatctactttgcagtggctgttctgaatgctgctcggtgtttgatcccttgtgtgtcctttgtgagtgattgttctgccaccagttgccaaaatatctggatgggaagaaagactctagtccatcagtcatctgcatgcttttgttcatctggggatgggaacatccaaggtggaccgaagcccagagagcacagtgaccacaaaacccagcaaattctgaaggggaggaggtttaactatcaaataacctcaggacacatctacagttccagggatgacgtgacagacaagggggtcttgatggaaatcctgtagtcccagatgctgcgccctaatgggattctgtaaatattgagataaaacaaaattcctcaccgatgggctgctcacagcggctatgttgatgacaagctctaaaggcaaagggactgagtcatcgttgacaagacaagagacttgttgttgtgggggggcatttattagctccagcaaagaggctctgagaagaaactctataatctgacatgataaatgaatggcccagtgtaaacctttaattggtctctattttgaagtattaggtatagccagcaggcaaacctgaggccaccaccggattttttttttttttaaaacacctgaaattctctttgagttgatagctggctttttttcttgaaatcaaagaattaagttcctaatggggatcttactgtcactcctgtcctagaaaggaaagcaagtagaaccagcgaagtatcactttcaaatagcctactgcctttgtgggaactcagccacggtctctgcctggaaggtccacctggctaccttgctggaaggggtgcaaggagatgatcctggttataactaggtctggtgtgggcagtcttcagactcgcctccacccctaattcattcatggcttctctaaagcttctgaaacttcaagccccaggactttgcaacgtttggctgcacaagtcatgaaagcaagatcacagtgtggaatttatgatgtgccctgagcctgggctcaaccaaagcagatgctgttagcatttccaactgcaggcttggccagagccgggaaaaacagacacatctgtaaaggaaaacaataggcttaggcatgagcctgcaaatgtggggcaccgagcctcatcagggtactagtaggttttctgctaaggtcaagtccaaaccttccctctggagaccattcattctgtcttttatttctcctgcttcctggaatgcttagtccatggatgaatgtctctgttcaggtgatggggtcaggtatggctataaactcttacatgacttgtatttattataatctctggggcccatttgcaggtaagatcccccgccaaaacaggaaagtcctagccaggttcagaaatctgcttcctgctcttttaaaaataagcgttagcttatttctgagctgggatagaaaagagccagtatgtatttgcacctcctccaggttagaaagagtgctgacggcttctgtgtttcctccctgaggctcaccaaggcccagtgacacaggtgtcaggaggttctttgtgcagatatggaaaggaaggctcagggagggaggtcaggtagctcaccaaaggacacctggccagcagctggggagccagggtcaaattccagcctgtctaaccacaaaagtacacccttctgactccaccatatgagccgagaagccacaaaaagaagagttcactttgaccccagaagacatttgttggttctgcttagctcagctctagagtacgttgaacttggtcctgccttctttccaagctgttgaagaccatggttggaactagaagctacaatttagttgggtccctctggctcttggaagaaaggggtcttcatatgcaagtggaagctatttacgtggacatatcagcagcaccccaacacattttaagatctctgaggggaaaggcagcaccttcacctccttcatactgtgccatgattctcagatgtgggaacttagatatttctaaatgagtaattatggaaggctcagttctcactgttttgaatgactggattcctctgaaggaatatgcttcctggattcccagagttccttacgattgccaagattgtgttgacttgtgtcttctcagaatgactcttcccctcttctatcgcacgagccacatctctggtttattcttctacaccccagtggtgaaagcgaaacttcattggctgagggggatcacagtaggagatgtccatattttaaaagacacactggggtgtctctcaagggagaggcaggtactggagaatctgtgcagcctggattggttcttctcagcaagttcacctcactaggacacgctgaggcagggcagccacctgagaccactttgtcaagccatcaagaacgttatagaagtttgggtggccttttcctccacttctaatataacatctttaagtgcttcctcaattttttttttttgcatcgtcattatagggcaaattgaagaaactagttttctatttccttcaagcaaaatagctgtgacaaactagtctttggtgcactgtgccagttcattcagctcaaggacatcagatacccagctgaagatgagaatggtcgaagcctctatgtcggccaacaatattgtttgggagcttaaaatcaacatctgctaaaagcggaaccattgccagataaccataaaaaagggtgggagtgaagacaggctttattttcgctccttcatcgatcagtcattaacacttggctttgttaaacaaagtgaaaattgtgtttttaacatgactctggttctgccatttccttcatggtaggcaatcaaatttccttttgactcttcatttcctcagctgcttaaaaaagaaaatgaggggaggctgaggcaggagaatcgcttgaacctgggagatggaggttgcggtgagccgagatcgcgccattgcactcactccagcctgggcaacaagagcgagactccgtctcaaaaaaaaaaaagaaaaaaaaaagaaaagaaaagaaaatgggactaccatatcctggccctgatgcttcataggtttgctgtgcaaattaaacccaagaatgtaaattaaaccactttgtggatgttacagacttagaccaatataactagacatatcatccctgttggtagcattaagagttgattactagtaaaacaaattatttgatattacactaaagctgaaggcaaaatggtgtgtctaaaaaggatctgatggggtacaaaatgattcttaaatattttagagtctctgggctgttcaaaattgacattattaagatcattaatagatggatgcccaaatccgaatttttaaaatgctattggtctgtaaggtggtttcctgcaataacagactttgtgagtgtgtgcagggtatgtttaaaggatgcttcctactccctttcctctgctggtcccttatctttggagtgctgcaagtgcctggagtgttgtaagtcaaacatgatccctattacatcagttatagaaaaaaagagaggcaatggtgtttagcaatataaaatggatttccctgcttcccgacatttcaaggttggccaccccctctcaatgggggagctaaagtgctgcctcttagacaaatgcgactggattaaagcagcaagttgaaaagaaatcaaccctccaatgttgccaagatgcgttgcatctgtaagctggagagtgcaggctatgtctgaaaaacccctgttgactcaaaggatactgcaacaaatctcttaatgtaaccctaatactgcaaacaaggtgtaaaacctagacaaatcagtaaaagaaaaaaaaaacactctaccccaaatagcataagactgaatgaaatcttcagtaggctcaaacctcctttaaggaaaaatccttttctaacaggaggatcctgatgcattaagcagctctgcatttttcccatactcagtgaagaccctacctggcagggcttattaatcatgccctcatgtgctcacatgcagggaattagcatcgcacccagattaaagggctttgacaataacctgctcatctgcaaagccagcttcccaactgctgcgtaactccgcctccctccctctcctgtagctcttaatggttgggtgagcatgtaactgctggtagaggaaggaggcagttaaatacctcccacaacaacagttcagacatttgtccccatttccttctttacctgtggcctcacagagagccactgcagggttactctacagcttctgctcttaaaaacaagcaaacaaataaactgccccttttatttcccaagggtgggaaatcacatatgccgtctggctcactttctagtagttttggggatttttagtagtctctgagggataaagaaaaaagagacatctgcgatatctttctatttcttaacctgctaaacacagtatcctccaatctacttgtgagaaaagaagtattgggaaagaggcaagtggctctcaagagctatttcaaaatgcatgccaggatatccttggctacagttctgaaaggactggcccaggagtggcaacggtcaaaacttctgaacccttctcccatgcaatacacatcagcaccaataagaggtttcttcatgggttgttgaatctgaaggcttcatccccacgtgaaacaaaactcaaggctccttccaagaagtgggccatgacattagatttgcaatgcaaaaaaaaaaaaaaaaaaaaaaaaaaaaaatatatatatatatatatatatatatatactgtctcttatctgggcaagctttagacatactagcttggttggaaactgatattaaaagcctaaaacatgtaacttttcttatcaggttactatcatggggaactaaagattcctggttttttgtatgttccataactatactttagtaagccctgatatacggtgttaatttttcttcagtgaaggaaacatgaagatatatttatgtgcacacatacatatatatgtatatataacgtatattcaaacatgcactcagaggaagttagggagagaagtttctagctaaacatgatcttgtgaaattcttccatatgtggaaaagtcgtcagttcatctgacatagagcaatacatacatatatacacacaggatgctatgtatacatttatcccacattcatttaacctcaaaacataaaataaattctttttattcctccctaagcaaaagctaggaataacaactctatatacagaattcatcttctgggggcaacagagcaggttggaccccttgcctgtctgtcagagttcaaagggctgcacattgactaatctgttggtgaaagtgcaagggaagcagagcatcaatcagaaaagctggccctgcattcacagagaggggctcagtgggagtacgggatcccacggcctcaagctggtgccccaggaggggctgctgtgactgcttcattcttctgttggactgtgaggccccaccaacttcttgtggactaagcataaaatgcagaaggaggacaaaagcaggtgggttttatgaaaaaagaactagggccaggaaacacatgggcctggagctgtcacctgcctccagccacaacatcgatgaggacataattgcagggatggctggaaattcccctctttaaggaatgctcttataggatgctgactaattctacctgagagcagtacccaaggctcaggtgtatgcagaatggacagaggtaggaggtgagagagcaaaagccctgcttttcttttctgagccaactctaccttatggctcttttgcctgtagaaagaggggagaagggacatatttagggaccagaaatctcaaaaccaaggcagtgagtgctgcagcctctctgaagcagagtataggttcagtactgtaagcatctgcctatatgcaagaatccagaatccaaacacagaaaggaaaagcagattcctatcaaccattataaattaggtcactgggatcattttactgtatcttaaaatacaatctgtgtatcagttctgtgaccagagtttgaagagaaggccaaatctaggcatgggttctttagtaaccaagaaatttgatggcttatggcaaaacaacatgtgtcccaagtagaattctatgggaattttcagcagaaaatggaagtgaacattcaatgctctgaaatatgtccaatggtacaaacacgcactttggctgagagccaacacatgctgggaccacacagtcatcaggagcagcagagaaagcaccaaggattactatttatatccacagacagattctggaaattaccaagtagagtggataatatttaggattagggcaatcaatttcctaggacaagatccatagaatggacagacaccttaaagttcagaatgcaatagggaaaacctagcttctaccacagaaaagtcactctctgaaagtacccctagcaccctggctgatctgacagcagcccttagcagaataaagcatcctctgttttgctctgggggcatggtttgctccagatccttacatgttcagaggctcaggggagagtgagcaagggaatgtgagtcttggcaatccactgccaagaaccctctgtgacccagagcagttcccctccctccccgggccagtctctccactacttgaggatctcattctggtgattccatagaagcaggagagtttgcaattggcacagggacagcaggaatagagaagagtaaaagggaacaggtaaaatggggggaaatggaaggaataaactcacaaaacagaagaatggaaataaagacaatgaaagctggggcaaatggaaagagaatggatgagactacatattttttcttcttttttttttttgagacgaagtttcactcttgttgcccaggctggagtgcaatggcgcgatctcagctcactgccacctccacctcccaggttcaagtgattctcctgcctcagcctcccaaatagctgggattacaggcactcaccaccacacccggctaatttttgtatttttagtagagatggggtttcagcacattggccaggctcgtctcgaactcctgacatcaggtgatctgactgcctcagcctcccaatgtgttgggattacaggtgtgagtcactgcgcccggcaaagatgacatttaattcaattttggaaaataaacaaaataggataaaatttactacaattccatgggaaagggaaaaagcacatttgcactcaagaataagtggatccatcatagttgtgcaatcataaatacacgtggttgcatagatgtatccaaggggtttgccaccaatgtatagtactcagagactcaggatttcatctggggcctgttgactttcagttttgtgactctggatcattaacaacctctgagtttctttatttatgcaatggggatacttccatctgcccttcctacttcccgaagctactatgggagcagttcattcaacagacatttacagagtacctcgtaagggccagacatgtgtgaacatgggacaaagaatctgaatataaaatgtgaaattcaaccaaatttttctgtaactgatcacataagtatcatgtctccatgctcctaaactcatagccctcatttagaagttggttttctgtaagtaaaatgtgaaatttaaaatttaaatactatcagaaagtctcaaaggtggtcaaaatccctcgagctctccaacacctatgagcgagtatttgcattcaatgaaggaggaagaggagagaagagttttctcttgggctttcaaaagtggccacctattctgaggtttccagccccaaaatatttaggttctttgccatttaggcccttcccaactagaatcagagcggcaagtgctttaacacatagaagtacattttgcacaaacaagcagtgagatcagggtccttgaagacctaacacccaacccaagacccgggaagagaaatgtgagtcctagatgcacaaagggtagcctgcatggtgcctggcattttaagttggctggggtgtggacctcatgctgatgctgtgcttttcttattcaccaggttagtctatacctgggagccaatggaatgagcttaataaaatatgacttttactgggacagtaaaacttgtatgatgcctagaaaaaggaaagtagaaagacttggtatcactgatatgttttaaggcagagaaggagatgctatttaaagaaaatgacagatgagactgatgacaacagatacagagaacatttaggaaaagctgaatttctacttggctttgtgaaatcaatcttggtaacctaagaaaaatctctaatgtgtctccagcatgtttcatttactctttggactttattgtttctcaaaacacaccagcagcttgtgtcatgggaaatatttgttgtctgcccccatggccacttcttgctttgaaggatttcccaagtcattactgggatttgtctagatattctacttggacatattcaatggctgtgaccatcctgggggtcacagcccaccagctattaaaagcttctctctcaggtagggggctagattcttgagctgccacactgcactgacttctcttacatcttctccaaatcttcccaccccctcagtaatccctcaagggctgtgtatttatgactattcttgatatcctgggtcctcaaccttaatgactcccttagtttagatctactgggttattggtgggatcactctttctcagatattattgcctttaagaaggtatcccaggaaatgaatggaagaggcacttccattttcggttgtgcaaagcaagaagctgccggaaaatcccaccttctgataaaaaatactgctggaaactggatcagtcatgttataaaatgggtagtctcttttttcacctgatactctgagaacaatatttcttacagcacagatgttacttgaaagaaaaaagaaatctacaatcaaataagtctgggaaatactggattaaattaaattggggagctttctttcttatatgactttttagatcctttgatctactaattgccccaggacgctcgaagatagagttgtaatatggagcactttcacaaaatactttgcccagagaatctttgtttcaaggctttcctcatgggactaatgttctaaaagttactttgggaaatgctagtctagacttataatacttggattcagtttctcttaaggagcaagaaaaatcatagtgaaggagaaagaaacatggaagaaatggaaaaagaatataattctgtaagtacctggcaatactcacgtaattgaattacctaaggtaaaacgagtttttctggaaaagtaacaaggcaaatgatttttcatatttctccattttcatgtgttctgatctcttaataaagttcaagaggcaatatcaacattttgtagcccttcttccataagtcattgttggtcaagcctttaaggccacaggaaggccagggctggaagattcacagaaagggaatcaggaatccctgaaagagacctttcccctttaagtcaggtcagctaacattatgtacattatgaacatttagttaaaatctcatccacatcaccccattattaggactctcatgctttcatatggctgtcatttttctcctaagaagaaacatatactcatatgtaccctgtatctattagtgtatgtggtctacacaattaagtgtagggtttgtaatcaattgggaaagataactattgataactattatccattgataacgactttattctgggacttagatttataacagtacatatactgatatattagttattggttaccaaatctcaaatctccagtataggacaaggtatcattccactagacctgggatgcccagtcaaaaggggcatccagctcaggagatatagccatctccagcactggtgccaacctactctcacactagggttccttgcttaatctctccttctctaattaaaaaagtctagcaaaggagccttactgacttgatgacttcaatttaaaaccacaaaaatatccttgtggtcaagggtattttactttcacagtgacccccactgcagaataagtttctaaggtatgggcccctaattaagttggagctaccttttatctgccttgttctgattgacatgaaccagaaaagaattgaacaagacatcagacaacctggattcttattctagggctagacagcaaatgccttgaagacaggggttctgtccatcatgctcttccccaagtgccacatagtggctgccatggaattaggttaggaactcggaacaggattccagcctattcacccacttcccgggctccagatttctcatctggagaaggcgatgaggttaactgcctctatgtccatgggttgcttagagtgttcactgagatggtggatgtgaaagtgaaagaccatcaccatcttcctaacagtagcagtgagaaacatgtgccaaaggtctcaacaacgtggcttagccagacactcttcaaggaatgctaactcttctgggaaggacaccaccctatgacaaactctagtgtcagtggacaaacataagagtcagtcaagtggacaagacaccctagtttgtgattacacctctctggaaaagtagcaggagcctagcttttgtaagaaataccattcacaaagcagatagatgtgctctagtgcctcattcccagtagaacatatgagcatatgtgtctctgtgatgagacaagctggtttgttatctcagcaggtccctggatgacctactcccctgacttggctccaaatccttctttctactcttatggtactctctgtttttgtctctctgttggggtttgagtgggggaactcaggatggtcttctagcatgtgtggctcagaatgaatggccaaagtggggactgcaggctcccaccaataaaacctcatactcaccctatctgggagaatgccaaggagaaaaaggcagggaccaggaatgagaacgagttggtttagttagcaggatgccaggtctactggagcaggcagaggtggggaggtggtagtggtggtggtggtgatggtgaagggtggtaattgaataaataaaaccaaaacacagacatacaagataatgacatgaaattgacacctctctccacatttcagatctccaaatcaagagcaatattttgggagctaaaacatgaaatcatgccctgtctgtacttggcttcggaaatctagatttttttctgtgtgaacaccttcagcaatgttggggtctcggagggcaaaagcttccaggtacaaaggtcaggtcaagctcaggggctggggagcctcctggtgctggctgcctcactgcacagctcccaggagaacttctaatgctgtgttctatataaacagctcccccaggacttgtactccaggtaaaacatcttggaaacttcaaatcttaacctctttgggatgctagcaacaggaggtgaaaaggaaacagagccacgtgaaaagttttcggagcatcacaagtacctcctcccccagcaaacaattaaactgcctcttcacacaggtaattctgacaacccctcaccctgccatatccaaaggagtgcatacttatccagatggttctattttgttacctattgctcccatctatggaaatgtatcagttacactaggatcaccaaaaacgggggcagggggaggcaggaatcttagtacaacaaagtaagaaatattgctcatattgactatattatcctgctagtttgcatttaatttcctaatttccataaaattcaccttcaagagttttaatactaaacattgtaaatagtttttgcatttggtgggtgaatgtaaatattgctgtaaaaccacaggcggtttttgtttttgtcaatccatcttttcacatgcgttacttagtcaagggaggagatagggtccaaatcaaataaaccagactccttgacttcactggctaaaacgcaggcaaaacggatttctctccttgttgttttacctcaccattaatttgcatcactaaagaattttctaggaaagtgctcagcgaactcaaggcttctctggttgccaagctcatggaaacaaagtgctttctcttaaaactctgaaagagacattccaaagtaacccgccatgagataccgagccagcaatagactacatatctatgaaagaagaaaggaggggaggaaagaaaatgcataacataaacaagaaaagacaaaaccttaaagaggaaggagaaagaaaaacatttagattccttgactgatggaaataaataccaaagctattagtttcagttcaaagaacgtatcactttatgatgtttattatttcttgaggattatttattttatcttaaaatatctaaagggtaaaaggggtcttggaggtaagcagcgatgaaactgacctggtccggagagggcctgtgattggaatgttgcgacctcccaggagatcgatggtggtggtgatggtggtggtggtggtaatggtgatggtcatcatcatagttgtctgccatcaacttcattctgttctgggtctgtgcagaacaaaaaccaaggaagattccatcaggagccagaagatcagtcaaagagattcagggcataattacagtacctatagggatccctttgttcctaattcaggaattttcactgttagtcaagttgaaacttaataaagaaagcaccatgacattaactttggtgaaaaaagctctgtcacatccttaaagctattatgttacatctgtaaatgttaatgtacttccttcttgtgatttaaaagggaaaaaatggacatactctaaggtgctttgctttacattatcaagcaatcacagagatccaaggtgagcttgcaattgcaacaattatgactgagactctagaccaacactctagagcaagctggagatggaagtcctgtatggaaagatgggaagggctgggtagaaacacagaactacagataaacaatggtctcacaagacaaggcagaaaaatccacttgaacgctgccaaatgcaaaaatactgatggagatggtttactgctatgatgacttcttgggaaatggctctctacggacattttaaccgattttgttccttaagggaactgagcaaaaggtacaaagtcaatgggaaaagaactgaccactctaatttacaatccacgatgcctgtcacatgaggcaacttggagtcatggttaaacccccaatgcaatagaagtgtactgctttattatgcagggcaagaaatggaccagtgatgagttggcctgacaggctctcagaatctagaaaaatgcctaaagaccacgggaaaaaagcagacaaaattatccagctcagaaagtcaggaaatgagggtttgaggacagacctgcctggattcaagtcctggctccacctctttgctggttatgtgaacctaagagagtaaactatttataaaccttaatttcctcaactctaaaatgagaggaatagtgcctctttcctcggggttgccgctaggagcgaatgatacgatggacttcaagtgtcagtccagtaactggcaatgaaagtcaaatgctgtcattactatagttactgctgttgttgtttgctgtaagacatttttcctcctttgtatgtgctgcttcctttgcttgcaatgcctccctagccccctttcttcacctttaacttctatgtctggctaactcaaactatttaatctaggagccttttcctcaccctgtcctggaggctgggtgacacgtgcctcctgcataccatggctctataaccacagatttatccgtccgtatgtctgtagaccttgaagctatttctttcatctgcctctccctagaatctcgcatagggcctagcagatgtagatatataatacatgctgctgtaatgagtgaccaaaagaatgaaggggccatgattttgagggatgctgccatcctagagacaagctacatgtttgttttcagcagggaaggtcacggagagttgaggacatttcatgagttgccataacaatcccactggtggctcaagatgacaatgaaccaacaatactttcagagagccagaagtcagtggttggcagagcctccaaccagttggagttttattatgtaatataaataatacactgacaataaagaaaagtctggacctaacattgtgcattcttaatagtatttttcacatacaatctaacttattctcaatactttcccaggagcaattattactatcctcatttggcagctagaaaagtaaggtgtagatttcagccccaagagtctctttcttgacatagaacatggagattttctgggtcatccaattctcaatctctaggcttttttccttgtcttgctgctagcagaaaaggcaaacagctaaacaggtagaaagaactttcccataaaatgctttgattctgttaagttttggaaacacctcacatcccaattctatctgccagaggatgtcttatgatttactcactccatttttaaaaatgtgtacaatatttgaaaggccccaaagtgaatgttaaaaaaaaactgtctatatgaataaaaacaataaaaatagagggaaagagccacttaaaattaaataaaaaatcccaggcaacctctggcagctgagagcatttccatccttcacttgtccacttaaagtgtcagaagacccaatgggcaagttatgccttgtgagaaagagcaggtcagtggagctgctgcagactaagtactgagattcccctcagccagcctgccattgcacatgagattctgaaatttggcgtttacacctaaaattccagtattgtcaggatcctgtacttttgaactcatgaactaataaatctggaattgtttcttctaaatagaattctgagagcctgaggggagctgtaagatctgctgtgggcaagaaggaagggactcgctcaagaatgaaggatggagcctaaatgaacaaataataattctgctattgtaaacatcgtaatatcctcatcctttggggaagctcctgtgattttatgagattattttcttaccagcaacaagcctaaagttccctacctttgaactgtatcccataaaagaatgtacaagctaaacaagatgctatatgcagtcctaaatgtgtctgctaaaatgaggtgttggagagtaggcatgtcatgggataaagactgtaaatgaatgatgtcatctttccaatttggtgctgaaatataaataaaccacgttgttcatgtgaataccagatctgggggaaatgtacacagagcaattgtgagcggaagaggcttcttttgattagtctgggctggaagagaagagtgtgaaacagagatgaaaaatgagagtttggtctgatactctagaccgtttttatttatcttgcttgtaacatatcccctaaactgtgaccgatttcttaccggctagttgctggtgttctctcctataaaaacagtttgaccaatcttgatcctttaattgtcaaatttaaaatggatctcttttaaattttttttttttaagtctgcactatctagcttcatccccacccaattataccggtttacacatagacaagggtctggaaggacaggaagtcacaaataacactccctaacagtcaatgaaagaaaaactacagaaatttgtaacaaggattggacagggatactgtttgttcaaataactctaggccaacttaccaggtgatcccatacataatggtccacagccctgtagcctcagatgcttgaggtgcccgctgaaaagcctgaagcagcaaatcttctgggcaggcaaaactaaacacccaggaaaactaatatagagttggagagggattgctttccacagcatagcacttaggaactcagggactcatttagcgattcactgaggcccatttttatttcctttgcggtgtctaccaaactgctgaccagacacctttgcctttggctaactgtgttatactctttttactatattacgtcatgactgtggagacaaatctaatcagatttcattttctacttcctctttcttcaaggcgccaccttatttctctggggccatcgcctcctaacagctctcctgctgcactctcacctcccattgaacacattccatagccagagtgacatcagatttctgttcctccctggattcaagttcttgggaggctcccgccacactcaggaaaacagcctgggtctttgacatgcttaggcatctcttgctaggtgactgctagttacttccagagttacacctcccagtctccttgtcccagccttgggacatgctgttctctctctcggtcctgctcttcatgctctaccccttaaacctgagttatatccattagttctctggtcttagcttcaatgccatcatctccagagacaactttcctaagcccgcctcttccactgctttcagcagaatcctgtagccacccccctgggtctctgccatcacagaacttatctgaaccaatggtaactaactgcaggttcacttggctttctccaccactaggttgaaaatctcttgagggaaatactatgtgtggattgcccttgcactctccatctagtgcagagtctcatgtcttagctgtaagtaaaagtgtgtcaaagtatatgagtgtaaaaatggatggatggagagggcacacaggctactgtggaacacataagagggaagatgggagtctaggatgagccagttgagtatttaacttttgatgtggcagtttaacttttcctgtttatttgtttttgtttgttgtaattcttgggagtggcgaaggaagagtatgtgcatagctttggagctgttaggcaagtcgaattggtcttcttcaagaaatatgccattccttagctaattggacccagtgcaatactctaccacctccctgattacttacctcactaagaataaggggtgttggggtgttattagtttcatttcttactatcccctagcgtttgggggagcaggagcctttagaaaacctctgttagtgccaaaagtcaaacatggaaaactgaaactttatccattaactaaaatatctgatgagcaccatctgtgaaaaggtgccagatactccaactcttttgacatttctgaagagtttatccaaggagctcttgaaacaaaatgaaaatccttgatcgactagtaatagactcaatagcctaatggcaatatggagtgataaacacattgaattaaaactgcttttaaaaatattttagtaaggtggcaataacaaactttgctttgatcagtcatctggatcaagttaacgataaaaccttcatgaatacggtttaaatagaaaaaaatataataagatctgttgctatgggatatggagataatactgtacaatagcaattactgttttattctatcaggctttcttttctgtccctttttcccactagggaaatcccaaacgttcaggaactcttctactgtcttgtttccacctaatcagagcaaggtgaacagctcttgtctccaagtaaaagatgagcaaaccagacaagaatgggatggctaggagaggagagatttcctgaccatccactagactcacatagcaatgaatcataattgagtagaatctaagttgcagcactcaggtcacagttggaggacaaaatgaagtcagaggatgcagaagctattaaaggaatgtgccgcattggggaactttctgggagtatgtaagaataaatgatgtaaaggcttctactgtggacactgcactgaaattcactcaacacttactgaacatctgcaactgcaatgatgccaagaataattatgtgccaggctaagtgtttggccagcattctcctgctgaatcctcactcctgagatggctattcttggggccctcttttacagatgaggaaactaagcccataactattcagctagtgagtagaagaacagaactcaaacccagatgtctgactccagagtcctacagcagtgtcatgaagggtaaggtccactccaggtgcaggggtgaggcaaagatgaataggacatgaggaaatagaagcctgactataaaaccgtataagaagaggaggaggagagaagggtatggtttaaatggatgttcagaggcaacagatcccctccagctgagggcagaggcatcaaataaggctccatgggtcaaacgccccttgagttaagatttgaaagttggcttggctataggtataaggagagtacactggggagatcgcacagtaaagtggccctccaatcaccttgagaggaaagcaggtcaatgaggggaactagaacaccaaatgtgagatatgcaagtgtgtgtatgtgtgcgggcttccttcattcctttactggatgtggaaagagcaggaaatgtatgtgagatgaaaattcaccaccttatttttcaaaataacatcaacctgtggcatttggaaggaatttaagacagagccacagccatatactcacccatgtcacactgtaacatctctgggaaaatgggccaggctcttggcatctgtgtgtttacagatatctacacaatccactgctatagcatcagtccttccctgagcactggtctgatctccccaaattcattcagctgatccatccttcctgcccctcctctatagcagaacagaacactggtcggactctccctcccaactttgttaaaggtggctctctctctcggtccctatttacagacagaaatttagtagatcatcatgaaggtttggctggtgtttttatacctactcattaagcacttttattttattttattttatttttaattgttgcagagaatgtcagggtccctcctatattctcttgttccacaccagatcttgtctgcagcttggatggacagtcctggatgtgctgctgtcttcccaccaggagcccgtgcatcttcctcggcttgaggtcttgctttggccacaggtgcacacttggccagggaatggggcagatgggaagtgttagggagctcacgcccctgaaacaactctaaatctgtgagggaaggagatggtacataaatagccagcatcctggcccctcagtggacaaccctacagtgtgctccagaatctttcactaggtcctcagcagtgggagccctgtttgactatagcagaaaactgcccattgatgcaccctttgttggccttttcccttccctgtatcactgccccattctctcaccatgtttctggagatcacttctcaaataaactacctgcagtaaaagcttgtcttgggatctgttttgtttgtttctgtttttttttgtttttgtttttgttgttgtttgtttttttgagacagagtcttgcctgtcacccaggctggagtgcagtggtgcaatctcggctcactgtaacctctacttcccgggttcaagtgattaccccacctcagcctccagagtagctgggattccaggtgccttccaccactcccagttattttattttattttattttttgtatttttagtagagatagggtttcaccatgtcagccaggctggtcttgaactcctgacctcaggtgatccacccacctcagcctcccaaagcaatggaattacaggcgtgagctacctcacccagcttggggtctgtttttgcaagaatctcagctaaaaccctaatcatagttgaataattaacaagcctgcacttaatttttgcacaggactaacacacctgtgactcctaggctcttttccatggatacttcttgagagttctcatcacttagcgtgacagaactctcaccttccttagggaagtaacacctgcctagcactaattcagtttcggccaaacattcatattgagactcagactgaatcaggattccttgagtctcatttcctatatctaaaaaatgggcaagagagggaagaatgtcttcagcataaaccaaacaccatagatagacagacagatgctgatctactgctcctattgcatattttgtgcagtttttcttttcttttttcctgctaaagtcaggggagggaaattatgttgctaagttgctttctgtggccaggcgcagtggctcatgcctgaaatctcagcactttgggaggcagaggcagccgggtggcttgagctcgggagttagaaaccagcttgggcaacatagtgaaaccccacgtctacaaaaacaaaatacaaaaaataagctaagtgtggtggtgcatgcctgtagtcccagctacttgggaggctgaagtgggaggatcacctgagcacagaaggttgaggctgcaataagctgtgatcatgccaatgcactccagcctaggcaacagaatgagatcttgtctcaaaaaaaaacattgctttctgctgccaccttaggaacctggggaatcccctgaagggttatggacagtgactgtagccagaagcagcatctcccctgttctactgtcagccagtacagcccatgaggaaggattatttataaagaaagagttctatgtgctctgctcataatgttaggatcctaaccgacattgtgagatggagcctcctgttaacataaaaaataataaccaatgcctgcttggcccttgctgtgtgaacaacactgtgttggcatcatctcattaagtcagtctgacatcaaccctgcgatgcaggcaggggtggggattgtatttaaaatctttaatagctgctatgacagatgcagaaacccatgagaaccaagagtgacacagttgcacatgccctgaatatttgccttggttgaagcttcttattactcccactttacagatgaagaagatgaggcttagggattaagcaactaatcagagctcaaataactggtagatctgaggctctgactgtgcagcctcctttgtaaccagtgcatcccactgctcagatccttaaggaccagccccttcataaacaaatcaagactgacctgggaatgggctctgatcacccactccaatcatagctttaaagaaaagcagctcacttttgattttaaaattccctctgaaaacgatggaactcagacacattagaaaatcttaatggagccccaaagaagtccatgttactgaccatcccctaatataaattcaaaagtcattatgcacagtccacactagcgtttaatgcttcaaccaatgagacagctaacagctaggctaacacattagcaactccagacaaccaaggaatttctaacatcctgagcaccattgctagtggcagagtctgggggaagggaaaggccctagatgtttccaccacaaagttacttagttaagcgcaggtctgtttaattaagtcgtgggcagcacatgctatacttagcttttaaacacttgtaaagtcctcttcattcatttatcttacttgtcactgacaagctcttcaaggactgtaacagtatgcagagcatgaagagcctgggtaaacaacacatattttatgtggagtctaaactgtttcaactcagaaagtcaatagagggtctctgaaaaaaactccagactcttctactacagtgtggaaacattctgtgcatggtctgttaggagtttctttagaaagtgaactccaaataaaatcctaattttttaacccaaaggtaaaaagacaaaaataaataaataaataaataaatggaggagtggaagaagaaaggtgggagagaatgaaggagactgggaataaataaaggaaggaagaaaggagggagagagtgagggagggaagagaaagaggagagagagagagaagaggagaggtaaggagaagagagggaagagaagacaagagaagagagaaaaagaaaggaaggagagaggaaagacagtgtttgcaggtattgagattcggactctagaattgtgctgacaagtgaagacaacattttcattccattcataatccaacaaatatttattatcactggtttagggagaactggcatcatcaaaacagctccctaactaatgaatgggcaaaacagcctcggggtatcgcctaacagaattggccaataggctagaaactggagcgtgaacattctagtagaactctaggagcatgtgagattctaggagaatgtgaggttgagtaaaagccagcagcgccctccgaaagaggccgtgagagtcttaaacagggctatgaagagaggggttcacatacccttggaggcaagataattcacagggagtaaatgaactgctcaacagttacatatttactctaaaatatattaaaataaattataacaagcacatcaaagagaggtttcatagaaattatgtcttaggatgtggaaaacactgtgaaggtaatcctcaaaatgtctgaagcttgagacaccaccatcagaagggaagggtaaagcaaaggagaacggactgggcaagcagaggagactagaaactcaggtcagcccagagagaatgaacatgtcctgagaactgtgggaggacggaaggacgctctccttcaagggctttgaccttcgcgcagaagtggaagcaaatgcaatctgggcctgctcccagttctaaagcagaatggaagggcataaacctcccagcacctcacctccttcaaaacaaaacaaatgaccccccaaagggggagagaagggatggggtgagccatgcaaaacatgtggtggggctgtgttggccagcaccgagcacagttttgactccaggaggtgtggagacagccaggagaggcttggcagctgggagggagaacgagacagggagaggcagccaggcccttggagggggaacaaatccctctccccagctggtctcacgcttgggtgagacaactggagaaaatgtaaacatgctcattagcagttttccaatcagttgaaaaacaaatgggaagagaaaaatggcaggcgattgttccaaataccaactctctgccacatctcctcaggtgtttatcagagttgcccgctgtgctgtcctccctttcgtctggatcacaacacctttactagctttacacggaacacttggagctcaccctaactagggtcgatttagttctatgaggagtcacatactccactcaggatagaaggtctctgtggacacccccagagatgcacaaacaagacagggacatcatttgcaggtctccccacagcctcatccaagctgatattctctcagtacatgaacatgaaaactcatcaataacccctacctcttctcctgcgataacttacccccccaaagaagaggcaaagtggaaattttgtgaatctgtgtgtgaatctgacagaaatccaatttccagaaaggatgaagttatactcaaatttcatctggaaatgtctactgtgttgagtcatatggttgttttttttttcctaacacatcaacttgaattcattgaatgggtacatttcaaaaaacactttctcttagtcacctatttaaggtggaatccaaaaagcctggttgtctgtgaccctgaagttgaaatagcttaagtacaaaatgtccaaatgtatttaaacttgaatctgaacaaaaatagatactaaagtacataactgatgtttcttgatagtactaggaaaaggcgggtaacttgaaagttggggagaccgtctcgtagactagagaattttagggctatttcaaatctctcccctacaaataaggacttgccagaacaacccaaattcataaaatgttaatactgggccacatcttcaattagtgaatccaagcttactactttacagaggggagactgaggctccaagagggggaaggttagttgctgatgggcccaggagaaacccccagaatacttgacagctggaacctggccctgtccttgcccctggccgtcttctcatttgatttgcaactgcagatgagtccaccatgtccatgacctgtaacaccacaggcccgactcatgtcattggttttgcgttccaaagtactatggtattaatttccattctttcagtctaaacagcatcaaacacctaatcattttgttcttgatggctacagataggttaaggaattttccatttcctttgagataggagcctcacttctctagcagaactactgattaggctttataatttttcttttttaaataacatctgtaagtttttattatgtaaatcatacatgctagttatgaaaaattaaagagtacaaaagagtttataaaaagaaaagtaatgttctccctccctctgctccaatatttattcccgctgttaaggtttttctgccaatctttctaaaaaattttgtgcttaatgcaagcacagacacacatacttaccctttacaaacaatatctccaatattgttcttccacatcaagaacatagagagcttcctcatcattaatggttgcatgttattccactctatgcgtatacttttgtttaccagtcctctattgatgtgttcaaatagagactccaaaagggaagatatctttttttcattttattccaagatgcatcccaagcacctaaagcactgcctggcacatatggacatataataagtgtttgttgaatgaataagtgatgggcatttgggtcatttccagcttttcattttttccaacaatgcttaaaacaatatttttgcaaaggaacagctttgcttgtcctaatgtgtttgtttccaacaaagacggatgcttaaacatatcatagctgtttctataatgtgctaggaaaaaacaagttcaagagagaaccctaaaatagaatatacacattttaaacttggaaggatatcaccaaattcccttcaaaactgtcaatcaacatccagcctgtacctctttctctatgctgtgctaacatggagtttctccaaactctttaatcttcaaaaatatgataggtaaaatattgtatcccatgtgttccctaattataatttgaagctgagcataatttcattcatttagtgtctatttctacttcattatctgtgagcccccttttaatgtccttttttcccacgtttcttcttgatcatttgggaactatcttcttatttgttgtgagaataattgtatatctaaagaaaattagttggggctgatttcaggaagagaagagcataagtgaaggtgggaagagggcacataaaagcaggccatgcagggaagggaattgtgcagacaggtgagaggcgaggatgcccaggagcccagtcatttgaacactttaggtgttctcttgagtagaagagaaaaggggggaaagtggtaggtagttgatatgctgggatgtgaacagagttggcctctgttgaaccattagcaggaataaatgttagcagttgatatggggctttacttctctgcagaagattgttgggttttttgagtgttaagcatgcaaatgccactcatgcttgtgttggtagaaacaatctaatacaacctgctttcccaaacaagacttctctttgtagccatcctggtggatggtggtccagtcttcattccttatcactggagatgggagactcaatagctatttgataatgtattaagcagcttaaataggatgctccctgcctcctacactcatattttgagctttgtacctgcagttgtaccctacttctgcctttttgggcagctcacgtcttcagatatttgaatacagttatgcccattatctatttgttgttctctcaactagtcactccccacttctcctagtcctctctctgtaccccattgcacaaggtgctactacatgcatcaaggctcctttgagagaattctttgaataaagcctgaaactaagtcttcacatgtgtccttacatctgctaagcatgatttaaaaataagtaatatactcttaggttccattgatttttaccatctgctgtgcaatgctaatgctctaatttacaattgattaaactcatatcctggttgttagttcctctgccattctctctctctctctctctctctctctctctgtctcacacacacacacacacacacacacacacaaaccccagaattttaattctaagtatatacttcattcttttccttattaaaaaaaaatttttttttgagatggagtttcactcttgttgcccaggctggagtgcaatggggcagtcttggctcactgcaacctctacctcccaggttcaagcaattctcctgcctcagcctcccaagtagctaggattaccagcgcccgccaccatgcctggttaatttttgtatttttagtagagatggtgggggagtttcaccatgttggccaggctggtctcgaactcctgacctcaggtgattggcccacctcggcctcccaaagtgctgggattacaggcatgagccaccgctcctgtcccttactaaatattttgtttagacttatactgactaaatttgggtctatagtttcatctcgctgagatgtttctcaagtctgattttgtctgccattgtttttggtaagctacatggctttgatgcatcctattttcaccaaaaagcatgttttcaaaggctttgtataattagttccttgtacatgctggcaggtcacagcctagctcctctggcaacctccctatagaggtgacaggattccctaatcaacctgcctattataaagctgttcaatcaactataaatccatccatccagtccttatttctccatgtggtaaaaaagctattcatatacatataagtttgtcctgttgtattcctagctgaaatcttggtaccctggtaccctgcgactatgccattcccttgacttgtctttctatcaaccttatcaaaaaccaaagtgacgttagcattacttaatcttcaggaacaaataaatcttagtgattgctgattttattctcatttcataagacatcaatttaaagacttattttgcaatctaggtgaggaccaatattgaacctatagaacttaatcaacatgacatttgtcttttaggcatttagtggtaaagttctggaggtgggtaaaattcagaaaagcctaaaaaaatggaaagttaatttctgtcttctttgggtgctttcatccactgttggcaggattttaagttggcataaactttctcaagggcaatttggcactaggtatcaaaatttaacatatgtctaccctgtggtccaatagtctcttcctgaaaaaaatgttggagaagaacacagggatgaatacaaaagggtatcacagggatggcaatcataggagcagttaatgagaagtaaccaaaatgtccatatattaggctttggtttatcaaatcattaaatagctgttattcctataatgaaatattcagaagccagtcaaaagagtgatacgtatttgtattcaccagaaggaaagtgcatcacaacatataattaaatggaaataaaagcaggctgtgaaacaacatgttcatataaaatagtatataaaagtctacatttaaatatatatatgggtttgtatatatgtgtgtgtgtgtgtgtgtgtgtgtgtgtatatatatatatatatatatatatatatatatatatatatatatatgaaaagtacagaaagatgagcaccaaccatttataattattgctgggtatttggattttagggaattaattttctcctttattcctttctatattatttaaatattcaatcaggtacaagaaataataaaacaataaaaaaaaaaaggtttctctgctccctatacaaaaatgcagagatataaattacatctcatattagggggagatactgttgaaatcattttagttctggggaaaagactcctgagactgagaattttgactttggagaattgagactcctgttgccttctattttagtgaactacaacagtccattcaatggagcaccctaacttactggccacagctttcctccttccaccttaatcttttaaaattccaatttctcctaacaaccagcatcaccaatctctcttaagtttagcaaactgcaatgacaggcatggttgtgtctatgcacaaacagctggatgggaaaggaaaggttcccaagaccctgtcaggctctgaaccaagacactagtgccaaattcaagtcctcccccaagaatccaggggacctcggctggatcaagtcactgtctatctgaatgtcacatcatgggcctaagattgggagtatctctttgctgggtcttttcaagttgagagagttaatagtatagctctaagttcagaaaatatcttttaataatacagcgatgcaacaatgtataggctaaagtcatgcaaaaaaatttttctcattcccacacactgaacttggtaattatatagaagcttggacattaaggacccagacataaaggagtggattaaaaagcataattatggctcagaaacagcatgtgcctggggacactgccagccaagtcctaccctacaaaacaaaacaaaaaaaggtatgctgtggggtgttttttttcctctctgccattttgggaaataacccattaaaagaataaagcaccataatgattatttaggaacagacatgatttggaaactggtagaaaaataggtctttagttctggaattttaaggttaatggcccaaggatctctcagactctgaagctttataggacattttatttgaaatctgtgctcaagggaatatacttcaaatttccatgtctcaaaagctgtacaatggaaggaagctgttattttactcttggagtggtggttgggggatgcattaatgaaagacccaaatcataacctactaaccacagctaagtatgcagaaaataagaacatgccctagaaggcacccaaccttcatcaaacccagggcaagctttcatgagcagaatgacccagcaatctaatctcagcagccattttatcattaattgaaaatgctggttccaagctgactttgtgttgacagttttcatatcacactctttcttaagaatacacagtggctccctatgtcatgtgcatcagatagaaacagttcagttactgggcaaagccaacctctcactttccttctttaacaatccacctcctcccagcttcccccacagaaactctcccaaagattgtctgtctctaattacaagcacacagactgatctcaactcttgtgcttcccttgctagaaataacttctccctacaaaaccaggtacttcagcctccataacagttgggttcaaaatgtaccttattaagaaaatttccataactagcagggtcctggagagtaaagaaaaccacaagtgggatcagaaggcctgagccaaatggtcaaagttaagccacttaacagctgtgaaactacctgcaagttatttaacctctccaattatgtgcaaaaggcatcagcaagccgcttgatatcaaggaagctgctctagatacctgagctaagtctgtggcttctgattcccttttatagcccttgaaattctggaacaaggtccagaccctctctgtgctcaataaactctgtggatcaactgtctgtcttacccatcatcatgtgccctgagcaaacaggcttatctccacctccaccctgactcctgtgacacagtcctataccagtctccagttatacctttcctggtgacaattacagcccagagtgatccaaaatcttgccatttattttacatttccagtaggtgaatttgcaaggctatctatatatggagaccaagtgtttaggggcccagggattcccacatttaggggttactgactcatttcattagatcaatgcctctcaaatgctgatctgtcaaccagatctatcagcttcttggtgactctcccctgagattttgagtgtgtaggtgtgaaagtggccctagagtaggtattcagtgaaggaggaaaaaaagcttgctgggcgatgttaaaacagagtcaggttttaggaactgctgctgcaggtaatctaactattttaaacattgaggctcacggaccttgtttttaaagactgtgccttgagacagccagaaataacccagagaaccagaagttaaaataatcatctgtatcatttttataattatttcctctaatttccaactttaatttgacactgtccttctttacctgtcagtctatggggcacaacgttaagcctcttgggagttccaagctgggaattactgcatgctagaaaaggtccaatgctgttcactatctcttcttagcatgtccctgccaaggaataatcagaaaaggcttctttaaccttctccttcaagttttctcctttctccctcagggatgcctctctggggtccagggaagctttcatgcccgtaaagaccttggtgttgttggacatgaaaaccagcaggcacatatactaactttgtccctgaataagtatgtggtttctgtttggtttgttcgagaagctcttttttggatttgcacttcaacaccgtaagagatctgagaaacatcctaacatcctggcaaactgtcaggagaacaatcgtttgactggagaatgaggcctctcctttcccagaactatcctttgcattctctgagtttgagaataaatataataacaaccaaacaaccataaaagttagacccaagccttgacttcagatggctcaaggtgaggataataatctacaaatcaatccacagatcgtgcagaagggaggaaagatgttgtgctggttccctgatccctatctggggtcccagagttccatggaacattccagaagtaatttggctttgtgctcagtgcacagggactaatgtttttcaacaaaatttcataaggagatgtcgggataattttgggtcctgctctcaacagaagctgaaaattaggtgtggctaagaagacaggatcaggcttttttatgtgaccgctgttctgacaaagtacccaagcagtgaaaaattgtctgccttatcaccacagagaatttatgatggatttgtccaagaggagtcctgctcataaaagcctgcaaaacagatctattaaaacaaacctctaattatgaacagaacaagaatcccactgagataattttgcagctataatatcaagaaattcaataatcccaaagcccagtcacagaatcatccgacttgagaagatttgagtccgttaagggtgattactgggcacgcatgactgaccaccaaactaggtgagatgctgctgataaaagaaaaaagaacaggacaacagctttcaactcaagccatttaaaatatccaacaatggcttacaagataaaactgtttggcagcagaaagggggaacctattatcaagtatattttctggaccaaataccagaaatgtaagtaagatgacaggatgtgccagaggtcatgtaaatgtgggtgacctggtaaaggaatgtggaatgcctgacttccagccagcacttagctccttccactgtggaggaagtaaggaccaaggtcagaaggatgctctgcctgcccctcacagactctctccatgctcagcggagttattattagactcaagcatcacacatcactctaacattttcctcagagagaaatcttaggtttcttctacttcctcaattcttctggtcttggtcaggacattaatatttgttgaacagcatgtttttaaagtggaaagatatttcaaaaatcaaatattctggtttgtttcaaagaacatgttctcagctaaagcctgattctttcttcctgtgggggtgagccacagttggcaatgattcaccgaaatttccaccagctaacaataaaaaattatgtcccattctgaagaaacaaaagaaaaattgtagtgaagtcgtacatttcctttccagtccccaaagacaatctgaagaactgattcaacatgccgaattaagccctgagaatttatccatatctaataaggattagcaaatgttacaacactgaacatggcttggacataatttatattccaacttctaagccattgggtttagtatggtctcattccagccgtgacataggaggatacagagagcagtcatgctgtgtcctctgagaatccctgcatgacaagcaggagggctctttatgtgaaaaaaggtttctttacacaggaccagtacccacagaaccagaatgtgataactaagtctaaagaaccactgaggggagatgtgcagcttccctcaagcctaagaacattgttctagaagcagaaaacctagtgatagaacccactctgcctcttgccaaagctgggtgtccacctgcaacttggaaaatgttggaaacaattctaaattacatattgggagtgaggaagattaagactcctaaacttggggctagcagctctggttgggtctgctccattccatttttcatccatacttgccaaaagcacaaagaggcaactgggacatttgctcatactatctgctattaagataaatcagcaacacttaagtgtctggttcataaaaaataaacccccagagattgctcttcccccaccaatatatcaactttttgtttccctgccttagcaaggattgcatcagtagaaagctcaggaacacacaggcttttcctggaagccaaaccacatctcaagaagcctcagaagaccctggccccagcagaccccccagaagcctagacatgcaaacatcattgttggatgggtataaacacccctttcctggagggaaaaattctggaacccatcctgaactgggttctttcattcctttctttcctttctttccttctctccctccctctctccctccctctctctcctcccttctttccctccctccctccttcccttgcctccccacctcacctccccatcccctctcctcccctcttctctcccctcccccttcccctccccctcccatccccctcctcctcctcctccttcttcttcctcttcttcttcctcttcttcttcttcttcttcttcttcttcttcttcttcttcttcttcttcttcttcttcttcttcttcttcttcttcttcttcttcttcttcttcttctctctctctctctctctctctgtctatctctctgcccctccctccctccctctctttctttatgagacagggtctcactctgttgctcaagctgagtgcagtgacgcaaccatggctcactgcagccttgacctcccaggctcaagcaattctcctgcctcagtctcccgagtagctgagactacaggcacatgccactgcgtccagctaatttttgagtttttgtggaaatgaggtctcactatgttggccaggctggtctcaaactcctggactcaagcaatctttccgccttggcctcccaaagtgttgggattacaggtgtgagccaccgcacccagctaacagggttctttgaagacaatgtttgctcattctgttctatttgtttttcttcacagataaatgagtacctggctcccaaaaaagcagaagaggggaccctatgtttgaacactgccactcaagttctttcttccttggtcagtgaacaagtcatgtagatcctagtttatgttgagagattgtcaccagagatggtatgggaccaccattccttgaagcacagtgctaccctgtggggaagaataagatagccccatctttccacctcacaactaagatcagcatcttgtacatttctttaatccttaggggttttaaagaccttgccccagagaagatgcttcaagataatgcttctctgtgagttaggtaggaaacaatgtacccattttataggaaggtaagttgacctgctcagcatcatacaactagtgagtggaggtgagtcaatgagcaatctttggagctttccttcttcactgttgcctttgaaatctagaatcccccaatatttcctgatggggaaaatggcaattgtatcttgatgggaaagcaaatgggcagagtgctgcctttacgtgcagattagctgagtgtgtgtcctggcccaaccacttatcagctctgtgacttggtttccccatctgcaaagtgggcataatgatggtactgcctcttcaagtttttgtggggactataataaaacaaaggcacaacactgtgcctagtataccatttcttgaagaagtgttagctgtgttaatgttctactgaacaatgcatcttctctactcaactgtaggctctgcaaaagcgaatcctgccaattgcctgtgcatcctcaaaggccttgtcatagatcaagtacttaacgtactatgtgtgaatgcactggaataatctcagacaatcaaaactacaagggcttagaggtctgttagcttctctcttttactttacagatgggggaactgagcctgtgagagagaagcaaaatgagctgcccaaggtttctcagtgcattgggaccagagctgggctagaactcttgggtccattctcagaccctgaaccttctactgcctgccagggctcccctggggaggtgggttgccttgctttgtttaaacttttaacattacactttaaggtggcctttgcatcagacatctcagcgagcattagacccccaaaccaggaagactgacaacagaaactctgcctggctttgtgatccacatacctccttcctaccccagcaccctaagtggcttcatcacacccaaggtggcccagagccacctttctggttggcttctgagctgtgtttgtaattctaggagtgctgggccatgagaaagaggaaataagccagctgcaagataatcagttaattgtagtttctggggcgtaagaacagccttggatttagaccttctgagttgccattcttgtgggttttcactgttttctgggatgaccacctctctatctgatctaaagttatagtctttttgcccaattccattcccaggctgtgtcaaagatcatttgaatgaagattttttggttgtgcccaacggggtcatgtctcagtggctatatcagggcagagataagagaatggggttgggttgttgtatgcatattaaaaaaaaataataatgtcatctaaacactagtgttgtggggttctggctcccccaccttgtcaacttagcaactgcacgtggggagctggcccagaggaacagattccaactttcctggctgcagtttgtcctcactgaggtctcccctccatgcacagggcttccacatggctcaccccccacttggctggaaaactctagtgctttcccgggcagggtatctgtggaacaccctattcaaaatcagctccccaaatccctcatagagcatcatctttggtttttcccatagtatttattatcgtgcaacatgccctacatttgatgtctttattttgtttcttgtttcttcactggaatagttggggcagggaattgtctgttttgttcactgttgtgtctccggtgtccagatagtatctggaacgtagtacatgctcaacaaatatttgctggataaactgcctacttctttccatgcccacctaagttttgaaaatctctctctgcctcttgttgtctctgtttactgatcacttgcacttcctgtagtaggattctgccccaaatctatgagtggcatgttttcagaatgtagcctgaaaaatttaacacgaacagttgacatttatttaaatatttacgaatgtcaagtccactgtaggagacggccatttcttaatgctctaaaatcttaaaactacccacaagtctaataattcaactcttgggcattaatcctaaagaaaataacataaaaaataaaagacttatgtactaagatgttcatcacagtgtgattataaaagtgaaaagctagaaacaaatcaaaatccccaaaacagaatggtaaaattaatgactgcaaaatgatggaaatcataaaccaagaaatatgttttcgaaggcttttaaggacatgggaaaatgcacaaaatattaaatgtttaaaaggctaaacaaactttattatgtagtatgtcatgtctttgttcaaatatatatgtagacaatggaatgtaggaaactataaatcttagtgacagttatttctgagtagtgggattatgggtaactttagttttttatttacattttttgaagtttctattatgagcaaatattatttctatgataaaagatgtatctctatgctttcaactatggaaaagctcatttacatagaaagaatgctacaaaatcaaatccttattaccttttaatctagtgcattattaaggggtaacattgaaaaaaaacaataaacaagggagattctggaacttttagtgtgttgcagagaatcaaaagaagaaagtgacatcttccccaaaagaatataaagttgagaaagattaaaggcaaactactggaaattttaaattccaagtctgataaatgtcttcctgtaatcatgagaggagagggtgaaaaatccttttccttaattttcaggaaaaaaatcctgatactattatttgaaaaagctgaaaaagaagaagttctgaagccaggaaaggacagacctggtgtgcaccacaatggtgatcaatgacaaaatcaatatcactttaacacagcttttcaaggggcagtatgaagcaaaaaggaagtgaaaaggggcttttctttcattttgaaatccagcatcaggaggacacaagggcaggaagtgggatcttttttcaatgtatttgaaatgataaggtgaagacaggctgaaaggacttttaattatatgatgagaggaaggaacggagggagagagagaaagggaccaggaaaaacctggttttatatgttaaatgatgaaaaagaaaatgtaaaactaaagagaaaaaggctttccaacagataccttgagaatgaaacacaaaggctgcaggaggtaagtgccaacatttcttgcaagaaaaccaaaatgacagcacacttgattgagcctgcagccttctcccctagtggcaaccggtgatgtctggtgatgcaggaagagataagtcgcccttcccagcctgcacatggtggcctcaggtcatggcgggagccagcaggggccaggcgagaagggtcaggaggggtggggagtggttgctcagggtcacagaataaagccttctttattctgctttttagcctcaagtttacaggggctaagacctaactgaagtattgcaccaattcagggatagctcctgggaagagcatggaaaagcttcaatgtgagtcccatttgggctctggttccaccccttaccagctgtggcatctctgcatagttcctgaacccaagtttcctcatctgtaaaacagaattattaacatctggtttttagggttgtcatgaggattaaatgagataatatatttaaaatccctagcccaatgccaagtatacaataagagctcaaaaactgttggttcctcacattctaaaatgtgaatagaaaaacaatgatgaaaagcaaggtctctgcacacattatacccactcctaagcctcactgaagcaatgtcagtctaataactcccaaaatccacacagtctaacagctggattcctccccacaaagcctaatggctccctggtggccaacatcttgggaagtttctcctgtacacactctactttggtggtggatctgaatgttctctgaggcggtaatgaacaggttaaagttgaagggatttcaaacatgtctaatccaataagaggcttggtaaaacatgcgttatcacttaaagaataaatgtttaaaaatagagcacagatgtgaaatttgaataaaaagagagagagagcacagtgagagatcttcttggcatttgcatgctattccctgttttggtcaccttcagctaagcctgttattctgatatgctctgccaactgctcagtgctgtggggtgcttcaagttactgaagcaaagttggcaaatcactctgaaatttaaaaatcagagccacctccccctttatgcatttctaaaagccagggaacacaatggtaaagttgatcttttcaagtttttctaaactaatacttaaaaagcaaagagtgagtttctccactcctcctaaaactagcaatacttgtactgggatccttaaaaccctaagagaaagtatcatggttaaataggcatttgtcacaaaaggtgggctacagattgccaatcacagaattcatgggaatttctacttatgtagaaagcattctctgattcctccagcaggcaaaggtttttgaacttcagtaacatctctgcaacaaaaaaaaatagcactttgtcctattttatctttcatgagctagtatctatgatactgctagtagagatgataaaactccaaggcttaaggacaaaatcaacacctcctatagccaaagagtgcccataagtgctccatgcatgtttagggagatgaactaaaatatgtttaaaacagagctttcacccaaggaagacactcaagtgagagactcacacagttggccatcaggtcagcttgatgctctgggaagatgcccttctgatagggatttgaaaaatgcatgaaatcagagaaaatactttgcctccatattcactgagtgctattttttgttgcaagggcaaactgagtggattccctgagtactggggttgaggcaccagctgcctaggataaagaatgtttccaggctaagagagcagatgagtgtcttacccaattgcttggacattaagaggaaattgtttacagtaacactgagcagttcaggctttacctccataagaataacctgccagatctgagtatttctttttttattaaaaggggttctctagaatagactgtaaagacactttgcactgaagtcaaaaataaatagagatgtggctagattctaccggtgggacacaaacagcttaacccaaagtgggtctgctgtaaaaaccaatacatttgcattttagcaatttgatctggaccaagtctgtgatgcattacaatgctgggatcaaatcaagcttttctggaggtaatccaaacacaacaggaggctatgggaaccctactgcatggggttcctctactgctgtttaactgtgctaacctcctgaaccataaagggtaattaaaagtcatctgcacatgaagcactgaaagtgtaaatgggaagcacaaccgtggcttctagcagaggggagaagaaatgtctggctaaacactccactcaggtgcttcttactttcctggacaggacgggtctacctctgctgagatccaattttgactaggattccatccttgtaggtggctctcctgaacacattccagggcagcctctgccttctcccattttttaccacatctgcgactaatccttgtagactaatccttgtagacagtcctatgattttcggacaacacagggcagagaggctctacctaaatagattacattacatgcaacttgttatggcctccagaatgtttacctagacatgggacttttttttctgcaaaccccatgggagggggatcacagagaaccaggggactagtctcctggtcttaatgccttcctgctctagctgacctatgtgtttcctggtggccaaaagcaatgcccagaactggtaggaaaaggaaaagaaaaccaagtacaatttatctctgatctcaaaaatagtctaactagttctgagaaataagctggttctcattttaactaaacaataatgtctggccctcattttaaaaaggcatgttcatcaaggatgtgtgtatcactacttcagcacacaggggagcatttgagaatacggcttacggggtaagatttagttttaagctttcttcaaaaaccccttagtagcaggcaaatccagtgatttcagaattaattattttgatgtcagtccttttttcaagggtgaagaaaaagagttggggagattggctccaagacaccaaaaaaggaaaggtggtaattttcttatattttttagaactggcctccatagaaaaagaaccaaatcaaaatttaactgattcccaattgaggccctctctcaaaactgcacaaatctgcaagcaagattatttttaaaaagaagcgaagtaaaagtatcagaggtatgtgcctgtaaagaaacagaagtgaaaggaatacaaaagttggatagttttagatatctactctaccaaactagaatcaatcctttatctttttttaatgcaacaagtagcagaaagttaatttgtactgctcttttacctttataccatgctcagcctagaactaacccaaatgtcaacacctgaagagcatcacaaagattcttttattgttaagcacaattggaatttctgaactcatttcatatcacttttagctttattgacagatgtttaacaagagttaaaacatttctaggcaaattgatttatgagatactcaggagttttcagggatgaaatggacggattcccttcataacagcaagcaatctctgctacttctgagaactcagtgacattttactcaaaaagagcccaagaaattggaggagatttgaactagaagaaggtaaaaaaatttggaataaaagtccaaaattgccgccaccccaattagttcaaccatggagaaagtcactctgtaaaagtgtcttgcaatgtggcaagaaagggcgtggtgccattttgtggtcatcagttgacacacaggcctcatcttctctatcaagccctacagactggtggtggctgcctagaatattggggtgagaattatgaggctaagtcttacctacagggaacaaggatcatgattgatcaatgatgtttcttttcttgccatcatgatttattcattcattcatacattcaacaaatatttgctgaatgcctactagcattcagcaaatgtgctagcaattgtgttagcaaaagataacacaattatctcttagagatcaatgatgagcaaaaactcatgttaccatattctcagtccttatggagctcaaaaactagcaaggcagatagctattattaaaatcatcacaaaacaaatggaaaattatatctgttacaagtgctataaaatggataatacatgtgctcaaaaatgtcagcttggcagatttgacccaattgagcaagtcccagaaggcttccctggagaagtgatgttggactgagattgaatggatgagtaggcattaactaggtaaagaaaagagggaaaaacattccaggcaaagggaagggtacatgcaagatacagagcacattggtttgagtttgtatttatcctaacccctagaggagcctgggaagggttttcagcagtaaggactggggggtgatgagtgtaacctgagatttatctttagaaaggattatgtttctgcccactgaagtttgaaaacagctggcctggcctggaggccagatgtacttcttctcctaggcacaggcaacccccagtgcaggccaagagttggggaatggctactcttgtctacctgcatgcctcttgacagcaaggaaggtcaagacttgtactctgacggcgtgttgttgagactgccataaagtcacggagggtattttgtcatcagccctactcccacactacttaaaaatctcgtcaggtgtgacaggcaaattctggcatgagttctcttttgtggccccaacggaagcagcagtgtttcctaaaaaggcaagccaagcaccttgagactccatggaggctggagctaggggatgtggagagtgagctcactagggtagccttaaacaggccagtccatagtagtgatgaggggagccctccctgttctgaggctgcagagctagtgtattctgcttcctaactgcacagaagttctgcctcagaatacaccactcttagcagatcctgcacaggagtcctacagtctattccacccattcccactctgacaactcacttccttgcctccttgctcactctacgccagccatattgggctccttgctatcccccaaacacacacgtacacttctgcttcattccgtctgctggaaaatccttcccctagacatctaaatggctcattccctcaccaccttcaagtccttgctccaatgtctccttcccaatgacacccatcctgtctaccctattttaaattgtcaccagatccctgatcctaccctggaactcctgttttgccttatactagtctgtatttttcttcttttctaccatacaatttatgtattatgtccgttgtttattgcctttctccccctattaaaaagtaagcctgtctgggtgtggtggctcatgcctaacaatccccacaatttgggaggccaaggtgggaggattgcttgagtctcggagttcaagaccagcctgacctagcgagaccttgtctcttctaaaaaataataataaaacaagctaggcatggttgtgcacagctgtagtcccagctactggggaggctgaggtgggagtatcgctagagcccaggagttggagcttgcagtgagctatgatcgcgccactgcagtccagccagggtaatgcagtgagactctatcgcaaaaaaaaaaaaaaaaaaaaaaaaaaaattgtaagctacacaaggaagcggtctttatgtattttggtcactgatgtattccatgcctagcactgtaacacagagcaggcagtcaatgaatactcgttaagttgaattccaatgtggcaaacatagcacttggtctcaccaagctgcacactcctattaattcccatcaccctggacaggttgggagtcacaagctgaaccactggaactgggtttctctgatgacagctgtgaggtatgggggctgatcatggctcacaacattgctttagggagtcagtgttcagcctagccacaagcaaggtcttagcactcctgcagcaccagggccaacgctgcaccagatatgagtggtttgatggtgattaagtcatatagtctcttggactttggtttaatcaactcaaaaataagggtgatgctttccttattgggccagacaaaatatctgttatagatgattccccagcactgccagagagtctggcagagtaggtaggcaataagttggttgattataaggaaaaaatgagatgatgtttgtaaacttaggttaccataaagcatttggcatagagcctggaaagtggtaatcatgcattcattcatacaacaaatatttactgagcacctactatgtgcctggcaataactcagtcacttgtggtggtctgggaaggggagagattttctgtatacgttgagctcaaaaggctacctgggctaggcagtgtggctcacacccgtaatcccagcactttgggaggccgaggtgggaagactgcttgagcccaggagtttgagacctgcctaggcaatgtagtgaaaccccatttctacaaaaaaatacaaaaatgagctaggaaaggtggggcatgcctgctgaggtgggaggatcacttgagttcaggaggtagtggccgaagtgagctgtgattataccactgtactctagcctgggtgacagtgagaccatgtcttgaaaaaagaaggcagtctgaagagggtggcatctctcatgagccagtctgcctcaacatctgcacagaagactgagcaggccagaagggtggccttcccctttcattggcctggtccctgaaagagctctgctcttccaagtcagccatgcaggtcaagacaattgagatctgggactcacccttccaggactgccctccttcactgatatctatgtgtgctgcatatacaaaccaagtacatgcgcaagtacaggcgctatgggcctcttcagtgcaggctgggacctggggtccagggtttctgacatgtctgctcactgctccacaagtgctttggctttaggagaggaggaccaggaagcttaggtgtcaacatctatctgctctttctgccacagttgccacagctcaacaatgtgttctcaacatgtgcccagctgtttgcaaagcagtaatgatgaaatcaaaattaaactacctctgagggttggcagtgataatgtcaattagtagtagtagcaataatagtaacattaatagtaatagtagttgcaatagcagcttacacatatgaagcacctattatgtgccaggcatatgcaaagcacttggtttacctttcacctcacaataactctttgaattgttagcccaatttacagatgaggaaactgaggttgaagaaggtttagtatcttgcctgtaatcactcagataataaatgttagaaacaggattcaccttaaacagcttaactttggatgtcatcttttatgatcatttggcaaagggtctccttaagcattatggtatatccaactgtgaggctgagcaagatacccaacctctatgggcctctggcttcttctctataagagtatcaaaccctcagtcttgttgggaggtgatgagttgatgtatgtaaagcccttatacccatgcctagtacatgatgagagctcaaaagtattagtaattgttgttgatgtgatcaaataacctaagcctaaggactccaggcagaacccactgtttatgaacagctggagaacattcttaaatggtttttttggcatctactttacgtttatgaagataaggaggcctcacaatttctgggaataccattctgcttgacactctgaatttctccctgaacctgatggggtatgtgtggaatccggtagactatctaaagcctgaaccccatcacttacaagctgtgagtcgttggactggttattccacaccctgagcctcagttatgctccctagaaaagggagataatcctgcacacactcacatggttgctgtgaggactatgggacaacatctctgagggacactggatacaagacccagcatggagtaaatgctcaataacagggggttattttgatagcacattaatcattgttcttagagtcattatcattggcaataaggatactgaaattcaggtgatttttcctgctctttggtgggtggggtgaggaaggatatcagacctaaatcacgaaggagcccatcctcttccttcactgcatccttctccacaacagccctttggacactgccttagcacatacaggagctgaactctgcgtagctgaggtttcccaaatgtaccccatgacaccaaaaaccaagctcgtcgtaaagaataaaggcttcgtgcaggttcccaggaacaaactgaaggactatgctcaatccttactggaatcaagaagtgaattttcatgatgctgggaaagaaaaaaggtagccttaaaaattccttactgggaaaagtagatggggacatgaggagcaaagtatctaagagaaagaaaggaaaaattatccattctgcctggtaagaaggcttctggcagcctttgctctgcagctccaccaagctaattctgcaagagctgaccctatcaggtggccaaagtctggaaccattggtatatacacaataaatgaaatgacactgcaaatcatgatctaatgctatcatctatggtctcagtttttatggccatagagtactggaaatcatcaaaagaggtgaaggtcaaggttggatgagctcttatgcacccccacccccaatgacgggggcaagtgtctccttagcagctgactgacctgagacctttggatcatgtatgcatcgtagctggaccagtggtacttggccgtaatatctggactgtggccagcaccacaagtgcatggtatattcgagctcaagggctgtttcttaggtctataaacctgtgggagaaagctacaatggttaggtgcaggagaggagggtgcagggaaggaattagggaaaagcaaagaaagacgctcattttgactttctgtggccaagtaggtggaaaatccagtgtaaaagatgcacagctccaaacaaagaggtcaggtgtaagcaatctctgacccctgaggccagcgttagcaaggcatgccactctgtggaatgaccccagtgtctggcagtgactgggaccctccctctacaaggagagagtgttcagacacagtagtggtctgtctctctgtctctctttctctctctctctctcattctctctgtctctcattctctctctctctcacacacacacacacacacacattctctgtctctctctctctctcattctctctgtctctcattctttctctctctctcacacacacacacacacacacacacacacacacacacacacacattctctgtctctctcactgtctctgaacaaggcagccccatgagaaatgaactctggtgcagggtcaatgtatgccttttccttcctgaggggtaaaagggttagtcacattgtaagtggagggaacttattccttcaggcttcccttccactcaccttgcccatggtgcttggcacagatcactctagcaggcagagagcctgccccaggggctgagtcaatatggacacactccacatggttactgtgtggccattagagagcttcagagccacataaggccctaggtaaaatgtggtagccactctgcaaggccataaaccattgagctgactgagtttcataatgaactcgaatcttagtgaatatcttcaatcattgcttacaagagtcaccaagtaatatgaggaggagaaatatcatctgaaaatttcatggatgattttccaatatacttcaggtgtaattatttccatttaagccacttccagaaaaccttccagagagcaaggaattttctgcacaagttagaactatgcccctgcttccatgtccctcaaaacaaatacagtggcctagaggggtgaaaacacaggataacggggcaaacaggtgattttttaaaaatagagtgaagaatggctgggtggtctctaagcatagtctggcagtgctagaacctgggagatgctccttggctgaaaggtattggaggaaatagtcaaagaactaaagttgaaagaatagggaatgaaacctaaaaacctggatgagggcaattctttacagggaccagaaaatgagcaagacggaaggtaacaggtccaacaggaaagaattttgcccagaatttaaattataagtttctagaatttaatcagaagtcaaacaaagtccactggaggaaagaaagttgagagctatttctggggagatgacgctgacacaaaagaaaggaaaacagcactggttgcaaaccacacaagcccagccacatgcacataaacacagaaaagcagtaaaatggtgttgcagcgacaactgggtccattgcactcctacctggttttaggagcttgagcccacaggatggacatgggaaaatgaagagtggctaaaatccagagaaagcccccaaagccccaaacccagaaaaacacacctgtcttgcaggaggccccacctgctgctttaattgatgtactagtcggtctttttcccgcttgagggccatgacttcttcctgcgtctttttctttttggaggcagacaattccagcaaggcaatgtttgcatctttttcactgatggctgcaagtagtgcttcctgtctggtaaaataaagattattgagatcatttttgtaaaataaaaaaaaaaacaaacaattggcatttatagttgaaatgaaccacagagtattgtctcaatggaaagaaattatgaatactacttaaaacaaactagctctttggctttcagaatggacaaagtagtttgggtcagaatccctgagactgcacactgcagccactgagagaggaatcttttaatggcttcacatgttataaatgggaagggacaaatctgagcattcattgctgacacatttatccacccatccaaccaaacatacatatattcatctatccatccatcaatttgccaagagtcttagtctgttttatgttgttacaaagtaatgtctgagactgcataatttataaagaaaagatgtttatttggctcatgattctggagattgggaagtttaagggcatggtggtagcttccagcaagggcttttgtactaacatggcaagaaaagtagaaggacaagtgagcaagtgtgaaagagaccaaagtagaaggacaagtgagcaagcgtgaaagagaccacaagatcaagcaaagcttccttttataacaacctgctctctcaagaactaatttactcctgagacaagataattagtccatttgtgagggctccaccctcatgatcctcatgatctaagcaccccttaatgcccctgccttttaatactgttatattggtaattaagtttccatcatatgaacttttgggggatacattcaaactatagcaccaagtaagcttctagatactctgcgaaaacccccccaaaactgggtagcaatttcacctattacttttttaatgcaagattttcttttgaaggcaggcagagaaatttactggaaaccctgttctattttcaatgcatttagtgatgctcctttgccatcccaccaaaaacgattacttcctcagccttccttatttcagtaattacactaccatccactaagtagtgcaaaccctgaacttagaagtcatccctgagttctttccttctttctctatccagagccaatccactgacaacttcagtaggttttacttgaaagtatgccccttatctaaactcatgcactactataaaaacatctacgaaccatcagcatcactcactggggaccactacaaaagcttactcattgatctctctggtaaagagagtaaagtcatctttcaaaacattataagcccagattccaccattctattgtgtaaagatccattgcatcactctttagacttgaaatccagaccttttattgatgcttgcaacacattacgctaatcagccatgacaacctctctgagggcctctgttcctcttctccttcctcaatcattaggctccagcacatttcgttccaggtctctgctagtcctcaaaaatgttacccttgtcccctcacatcacaggctttgcctttctatgcttttgcctcacacagctcttatcttccaggtctgtgactgaccactgacttagaccacctcatgtccaagtcggtcatctgtcacattacactacttcattttttttatagaactctttgccatttgatagcatcttatttattatttgctttctagacttgacgctccatgaaattgggacctcatcgatcttgtgcaccaccaattctcaagcttctagaagatccctcagcacatagcgagtgctcaaaaatgttagttcaaggaagaggtaagttcattttttactttttacagacttttaaagatatcaccagacacctcttcctctcatttaaaaaaaattagaatgctttgcttcctgcttaacctacagtcatcgcttattcaaaaagttttaaagttgcctccttcaatctttacagtataattttatgaccacatctgtcacaaattttaacctggaattttctgggatgatttttgcgtaggaaatagctctcctgggtgtgtttcactgaatcttcctttccactgggaaagtcttatctccaccatttgtgtctcttctgaaacattctagacactttggaagaccccacagccccaaggaagcctccacattgggaacttccctcgcacacaaggcccaggactaaaacctggtcatgatcctgttttgcctttctttaatctccatcaccagaccaggccctctccagatgtttggacaaggtggtcattatttggatctcagattattccccttttcactgcagggatttatatggagttttctgggccccactaatgcctggtagtaggagcttctgtttgaagctcacgcagatgtgtgagcagcagaacatgtcaggaaatatctccattttccagaagaaaagcagtgcaggctggactaccggcagcagcattaatatccagcttcacagagcctgtctgcctttggataacagctgagacaatagacatgcttgcggctcccagccagtgcatatttatacagagggcgaagctgaagaggctatacagactttaaatcggggagagcctatttgctatctgctattccaaactttagctacaacacacaaggtgactgcaatattttatcccctctgttgcaaactgaaatatctaagtgaagcttttttaatgaaaacaaactaaaggaccgatattaggaaaattggggattggaggtaaattgactacacctctacaacggcatctttacagacatatgcaggtatttaaaatgctgattaaaaaaccttagtgatgtgaaaatatttatgtttgttgagaaacaattctctatgagtctctcatgtttctgtacattttacaagcacaggcactattttcttttatgacaaactttcaaggccgtttgtatagtgactagctttgaaagacagaggtggtatttctttttggatcaaagggaagacacgcttactgccccatataatagtgtctccttccagagcaaaaggcaggcatgttactgcccattataaaatattcagattctctaatctcagggttgccctcctataatacaaatgactacatgtatgtgttcatccagtccatccgactggcctccatgggacttggagctaggaaaattgacacaaatatactaattcttcactctgtgccatgagcaataaagtcctttatctttggcccagaagtctcttgtcatctgcctgcatccatggaactgaggcaggctaacttgttaggatgccagtagggaagatctcagacccttcatagttttcgacatacaaatgtatatatatccaagataatccctaaaacataaagctatactcataggaaaaaacaaggacaggaaggaagtataccaaaatgataataatcaccatttcaaggtgacaggatgaataagacattttttaacttttttctgcttatacttttaagcattattcttagaaaatatcctaagagtaaacatttaaaacttgtaagttaagctttcggtcatcaagtaaacagcaggtacatggttcaaaatcttagcaggtatataatttgctcattttcccacccaggctatctataatatgttctgtctgtccttccattcttcatgcacagataggcacacacacatattttcacacacacacaatgtctgatacaatctacatcatctaccacttggaaaactgtagtagtctccgaaccagactccctgtgtctactttcagcctgctttaacccattttccttttctacgtcaaaatttgagattatatagctttaatcactgtcaaaagtcatcatcaaccaaaaaacaatcattttttaaaattattttactttaagttctggtgcacatgtgcagaatgtgcaggtttgttacatagatatatacatgccatggtggtttgctgcacccattaacccatcatctacattaggtatttccctaatgctctccctccactagcccaccaacccctgacaggccccagtgtgtgatgttcccctccctgtgtccatgtgttctcattgttcaactcccacctatgagtgagaacatgcagtgtttggttttctgttcttgtgttagtttgctgagaatgatggtttccagcttcatccatgtccctgcaaaggacatgagctcatcttttttatggctgcatactattccatggtgtatatgtgccacattttctttatccagtctatcattgatgggcatttgggttggtcccaagtctttgctattgtgaatagtgccgcaataaacatacatgtgcatgtgtctttattgtagaatgatttataatcctttgggtatatacccagtaatgggattgctgggtcaaatggtatttctggttctagatccttgaggaatcgccacaccgtcttccacaatggttgaactaatttacactcccaccaacagtgcaaaagccttcctatttctccacatcctctccagcatctgttgtttcctgactttttaatgatcgccattctaactggtgtgagatagtacgtcattgtggttttgatttgcatttctctgatgaccagtgatgatgagcttttttgaatatgtttgttggctgcataaatgtctgcttttgagaagtgtctgttcatatcctttgcccactttttgtggggttgttttttttcttgtaaatttatttaagttctttgtagaatctggatattagtcctttgtcaggtgggtagattgcaaaaattttctcccattctgtaggttgcctgttcactctgacgatagtttcttttgctgtgcaaaagctctttagtttaattagatcccatttgtcaattttggcttttgttgccattgcttttggtgttttcgttatgaagtctttgctcatgcctatgtccttaatggtattgcctaggttttcttctagagtttttatggttttaggtcttacatttcagtctttaatccatcttgaattaatttttgtacaaggtgtaaggaaggggttcagtttcagtttcctgcatgtggctagccaggcttcccaacaccatttgttaaatagggaatcctttccccattgcttgtttttgtgtatgattctaaaatttaggcttttaagctttaacacttatttatcctctcataataccataaaaaatcccaatgaattaatttctaattctcactttactgtcagagaaaaacatatatcaatttctaattctctataaatgtcattaaatacagttccaagtcaaattagccttaattatcaaatctcaaagtacatttaaaatctttttaataaaattacatttaaagccactcaccaaccttaaattaatattcatataaaataatctagtttgctctttgtaaccttctccttattgtatttttgttttattttgttttgcttttggctaacaaatctatttttatagatattggcattatataatcatagaactctaaataaaattagtgtaactaagattatctatattttgaaaccctcatttaaatactggccataaactaatgatattttccccaaaaataccttgattgagatctacattcaataattctagtccatttaaatcaaagggtcattagtataagataaaaaggtatataaaactagagaaataagaacatttcatacttcaggatatttggcaaggtattctgaatatgttaaggcttatctggctattacctatttgtatagatttggcaggcctagaattaaactaaatcttaattccaggctaacagagccattgaatttggtttttgaagcaagaagtttttaaaactgagttaaaatacctctttcttaagctaatagaatttagctaagacaggttgaacatcccaaatccaaaaaccccaaatccaaagtactccaaaatcctagatgctttgagcaccaacaggacattcaaagacaatgctcattgcagcgttctggatttttggatttgagacactcagttggtaagtgtaatacaaatattccaaaatctgaaaaaaatatgaaatctgaaatacttctggtcccaagcattccagatgagggatactcaacctgtaatttaaatcactgtgagctaattatgtatagttatgggttttcattatccctgccttaaaggtcagatttgttttgaggatgggtatactgaatataattttataaaaacgaatttcattttgctatccctacgtcagattctacactttcacagttcccatgagccaatttgctgatacattggcagaaatcacctaccaagaaaatcacattgaaatagattaggaagcttacattaaatatccttgcttttttttttctcgcggcaaattttggtccagccattgaaaaactggaaaaactaaaataccaccagttctgatgcaccacttttttttaaaggctcaagtttaaagagtataccagtgacaagacacttggatataaaccggaaacagaaaaatcattattttccccaatgaaagcattaccttctagaatcaagaccagatttatattgcttcagaaattattactgtcccatcaacctgaagagagttccataagcctgaaatcatgttcaatctatcccttttgcctttttacagacaacacggaaagtacatatatgcccattcttagacagttagtaggtttaagtatataccaaaggcttgcaaaattatcttgagaacattgccatcctcaagtaccaattactaaggtgatctgtctatgccccaaaatgtagcttaaaatatgaaaaggaagcccacatatactaggaaggaagataagataatgtgaagagaaataaatctataaaagtctgctgaatgccaagctaagaaagtgtatcatagacagcattttatcaacgtgcagcctaaacaaatgtcaaggggaataatttctttaacaaatatgggcaacaatagaggaaaaaagggggaaattctgtgccctgtcatacatttagtcaggattaacagtggataaaaatatgtgcaagaacacatttaataaccctaaactgtcattcagtgtgtaggaggtagtcaagatacagctaataaaacaccaaaaaaaatggttttagccaccctgaaaaaaaaaaaaacaaaaccttccatggaataaaacaaaacagggctgaagggcatctcctgccaagataaatgccttcttttgagtgtcgcctgtggctagccctcacaaagagagttccaggatcctctgatggtaatacatggctacctcacttatcacagtccatttaaaagggagctttgtaaacatttctacttcactccccattgctgtcgttctattaatgatgatttgagctctgaaagaggatctaaaattaatttcaggagttgcaaatgaggcaggccaattaggaactattacaaattggatttgggaagaagcattaacacattgtttcttgtgggttcttgttttagttagctgacccatctttaggaatgcattcaattacaaaagcagatgcttaaaaaatgcattccattaagaatgtttggataatgacatataagagaaagcctacattatgtatggtgcttagcccaggcagtcatgttctaatcatattgtggggggaaaaagtccgctcaatcaacttttctcagctaattactattttctttccctcatgaccctgaatattcaactgtaagttcagtaggaggtgacttcagacagatggtgacgaaagatcctattcaaaacagcctctctctcacccttggggtgagggttgggtggagatagatgttcatttgcctaaattttaaaagctgtgttttcaaatggcatcttgagaaagaaaagttctttgatatcaattaatatcaaccctacccaccagcagaatgatgtatgatatatgcagaaggggccatgcagaaagcaaagcagctcacatgaggtggggcccacagggtgagatatatttgaacaagcatgagtttcagtaaggacaaagaacagaccagattcgtaaaggccaggctttggcagcccagacttcttaatgtggtttgctccctgttgcccacctaaaactgacctcaaaaaaatagtttactccaattacggagaattctgtctttgaaacctaatagcacatgactggaatttcctaacacgggggccatggagtcttgtggaagttctttactctaagcaccagcttctaccctgttccttgctcagtgcatgagccagggaggtggctggcccatccggcggttcctccagtttctccaactggaccagaacactctcaagtgccaacgtcatgtgcttcagggcactaagagggcaaatgccagcatcatttggcatcctgctacaaatcagtaagtctgaagccaactgattttcccacatagaaaaggtccaaggccagaggaggagtgccaggaagagctattccccctattctaaatgtttctcttgaatcctgtccttctagagaattgataaaaaggcaatgaaggatgggagggaccattgtcccaggtcttggcagtggacatgtgtgaggcattgctcattactatgtgcctgatccaccaaaaaaaaaaaaaaaaaaaagaaacaagaaaaaaagaaaatacttcttttgagcactttagcctattatgattttttaaaaaacatacccacacaaatgaaatattactcaagtttttaagaggaggaggtactgatctttatttagtgctggggctttggaagcaaatgtacctgagtttgaatctcagggataaccttttgactgtggccctgggtaagttactcactgtctctgaaacttcaagttcctcataaataacctaagatggacaatcataactctctcttggattgaggtaggagaatatggtggaggcagggaaccgaaggccatttcactccaacttcctagaactaaattaaaaggaaaaccctaattttccatgcctaagtaacaaaaggaccaaaggttactccgtttgcaaactcccaccttttctgcatggcagatgggaagttggctgtctgcaaccaatcagactgattgccagcccagtcttcatttgcatagaagtgcaactttgtggccaggcatggtggatcatgcctgtaatcccagcactttgggaggccgaggtgggtgtatcacctgaggtcaggagttcgagaccaacctggccaacatggtgaaaccccatctctactaaaaatacaaaaaattagctgggcgtggtagcggacacctgtaatctcagctactcaggaggctgacacaggagaatcactggaacccagcagggggaggttgcagtgagaggaggttgagatcacaccactgcactccagcctgggcaacaagagggaaactccatctcaaaaacaaaaacaaatatgaaaaaaacaaaaagcaaaacaaacaaacaaaaagaagtgcaactttgtaacttcaccttagcctctgattggttgcaaccaatcagatgtttgcacaggaatgtgacctttgtaacttcacttcaggctctgattggttgctttcagaccgattgcgggccaccgcttcatttacatgaggtgagcaccaagtggtcaatgggaaacttctaggaggtatttgaacctgagaagattctgtatccaggccctgtagccactgcttgggcctgctcccaccctgtggagtgtactttcattttcaataaatccctgctttcattcttttgttgctttattctttccttgctttgctttgtgttttgtccaattctttgttcaaaactccaagaacctggacaacttgcagtcaagaccctctaccggtaaccggatcatcgtgagaattaagggatcacgcatgtaaagattttgttcagtgcctgagatgaccacacaagaaatgctagcatttgcttattaaatgacacagaccccaccaaagttaaagattcaaaggttttgcattactttctatgagctcccctttatagtgaatatatctaaacatgctcactggtctcttactttcaagacaaactttcagagaggcctttaaaattggtttctgttaagctgcacatttgactttcatgagttgacatctgctccataaacagacataaagaagaaaacagactttggagaggagtctgctgaccacagaagagttgcatcccagacaagccaggcttgacttggtctataactgtccaatatcattccatccaaattgataggaaaggccacgtgggaaataggcaagacatgatgtcacatagtttaagaaactgagaaatggaaatgtgttctgaaaggcgacttttaaaaagtcaaagtcaagtgcaaaatcaaacaaattcaaaataaaagattcttccattggaaaaaaatattttaaaaaattggtaaatctaggaagcagggagggtgagtgaaatgaagggacttccatgacatactgcaataccctctgttagtggtaatgttagatgatggtgcttggtcattcttgttattcccgttcagtaataagaaagcctctctgttgaccattcaattctgccaaggtagctttctatgtgaaatacacctaaccagaatctctggcaggttatagatgagtgataatgagaaaaccaaatacatctggacttcactgcaggacagagctttgtccagtatctgcctaaactaaacctattgtccatgggtgatcagttactgtcaagagactgtcgtattgcattaactttttggttggaaatgagtaactaccagaaaataggtcactgacatcaaggcttagcccccatagcatccaatcaattatttttttcttattggtgaagtgaggttatgtgtgtgtatatatgtaagtctctctaaaaacaatatgttttaatttcgcctctattgtatatttaaagctgctaatatttatttctcagtctttgcacagagcagcaaattgtccgcctacatcttgaactacatatttcccttcttaatttgaatattttgtgttaaatcaaaccttccattgtttatgtttacatggaatagaacattcccacaggctaaattgtaatacaaaacaaaacagatcgtcatgccattgctgtgagaagaatatgtgcagaagggggcacattctggaattctgttagcgcaacattcaaataaaattgaattaaggttctgtggagtggatttttttttttaaatgaagtcttgctctgtcacccaggctggagtgcagtggcatcatctcggctcactgcatcctctgcctcccgggttcaagcgattctcctgcctcagcctcccgagtagctgagattacaggcatgcaccaccatgcccagttaatttttgtagttttagtagagacggggtttcaccatgttatccaggctggtctcgaactcccgacctcaggtgatccgcccacctcaggtgatcggcctcccaaagtgctgagattacaggcatgagccactgcacccagcctggagtggatctttgtagagagaaaaacataaaagtgagtttattggaggcagctcctttgagagagttttaattcatgagaagggaaaaggcagttgtgcttctgcaaaggagaaggaaacacagggtggcatgtctgtgtgtgctgcaggtgatggtggtagccaggcaaagggcaggtttctgcgaggggcaggaaggtctgatcccttctgggagaggggctaaacagattcccatctgtttatcaaagctgttgattcaatgttaatcaaagctgttctcccttgttgtgcctgccacagagctggacagcaattcaagacaacctagaggagacattttgggagggtgaaggaaactgatggcttttaaggcatcctcaaagatgctcaaagatgcaattcttcatgtaaatgtctaaattactttgtgaagtctggattttaggtctgccatcttgtggccattgcaataaatattgcccttttcaatttttttctgtagttacatctctaataatctatattcagaaaaggtaccagaaagaatgcttatttaaaaaaataaacattacacatgggagagagatccatgattcagggggagctaggacatttcatattcaaatccccattctgctgacatttttcattctttgactaaagtctagtttcaaataattagctatcaaattatcatttaatacaggattgggactactaagaagtcagttaagaggtgacagggaagttttaggtgcctgttttttttttaaagaggtcatttaatggacacagagtttcttccaaatgaatgacagtctcagcatttctgtacttgccatacatttgctaagagaacacccagaataaaatagattgtcaaaccaaagggggcttcatacctgaaaactaagggaaattgcttttctggaaataactgaaagtccaaatgagtgagattagaaatactttattccacgccgtaaggaaaagaaatgagacaaaatttataatagttctgtgttgggaagaaatggttaaaacgccactatgaaaacacactaagcctatctaatgcacactcattaatcatgatcttgttgattgtgtcaacagaacagaaagcaaatacatgtggccattgcctttgcaaagtttcaccaatgcatcacagccttcaaatgaagaggaggcacaagagcatactcaatgaccacaaattaatttcagagcccaagttacagaagtatagaactatgcgtctacatacatacacctgaagccttgcactgctaagcaacggttcaaaagacaggccaaacaaagagctgcaagactcagcttatgtattcctaaattataaaaagttatatttgttagttacctgaaatttctggactcatgaatacaatttgtgggatgctactggagtgctccttcccagagtttgaaggaacctgaaaccagacagcagctgcagaaggaaagggtctggtaaactacctggaggagctccacatctggaaagaatcgcaagggagccagcccaagaaacaatggtatagaaagcagtctcagatttacaggatgggtggccttgtggctcacagaagtgaaatttccaccctgggaggagcgattactggaagcaggaacatttcagatatgaaattatgaactccaacctgaagcagctaaactgaatatgttcctctagggtggctatttactggccacataagcaaaaataaaccatccaggtggtcagaggcagttcatcaatttctccaactcattcaccacatatttactgagtgaccactgtgtaccacgtaccagggatgaatggggacaagcaagacagaaaccatccctgcttctctaacagcagaactcagagactgctaccacagcagaacccagagattgctaccacagcagaacccagagattgtccacagtcatgagacagacagaccctgtgatgatgccaccagacacaaagaaacacccttctattaccatcatgagcaaatgctggatcatcagcaataccgtgcaaagaagatatccctgaatcctgtttcccaattcaaatgctgggcaaagaatccatgtggcatttccctctgcatgtatcaaatactaggataatcaattcaaaagctccctcccagcccatcctcttcatcccgaatgcctagtataatccagttgcaatcagaagctcaaaataaacaaataaacagaaacatgaaacctcatagtcatagctactaggccgaataatacgaagttcaagttcacttttttatgggtcagaaacaattgaatatcagaaattttgtatggttcaacccaatagtcttccaaaatacaaggagttttattggtttctttgtttgcttacaacacatgcccatagatcattttaaatctttataattttatatcctcagagatgtaaaaggttgaggtaattccctctccacaatattcaacatacacccaagactgaccactagaggtaattaacccagtctgcagaaggccttttgcacaaattggaggtgggggaaggaggcctaggaacccagagaagtgacagaactcagtcctgtaaaagaggcccccaggcctggaaaaccacttagtgagaaaacatcctggtgaccagactccaacctgacactgactaccactccctgcaataccgatctgttgaatgctgagatcagaccatctatctccctggacaaccttgaggcttcccagctccactgaccaacaacaaagcacccctgcttagatttgaacttcaaggcatgggacataaggcaggggtcaaggaagaatggggctggagaacccttaaggtgagaggtgaggccagctggacttcctgggttgagtggggacttggggaacttttctgacaagaggattgtaaaaagcaccaatcaggaacttttctgtctcacaagaggattgtaaaatgcaccaatcagtgctctgtaaaatgcaccaatcagcgctctataaaacgcaccaatcagtgctctgtgaaacacaccaatcagcaggattctaaaagtagccaattgcagggaggattgaaaaacgggcactccgataggacagaaacagaacatgggcggggacaataagggaataaaatctggccaccccagccagcagcggcaacccacttgggtccccttccacgctgtggaagctttgtcccttcactcttcacaataaaccttgctactgcccactctttggatcagtgccatctttaagagttgtaacactcactgcgaaggtctacgacttcattcttgaagtcggtgagaccacgaacccaccagcaggagccaactccggacacaaagggattcaagatcccattgaagaggggcataatgaaaagatatctttaaggatgactgcatacctataggtggtggcttaaaagagcagtctaatgttgttaaccagtgtcttaatttctaccattttcaaagagaatttactatggacagaatacgatgctacgtgttatgaaggatcagcaatgggtaaggcttgcaaactgatctggtaaagaaaaagacttaaattatataaagacttaaataataaaataaaagataaataatagtttattaacatcttcattgttaagatacaggataagaaattgttaataattattattttgattactatatgtataagcaaggcataagtaaagtacgttgtttcatttagtctgctcaaaatagccttccaagagaaagttttattacaccccttgtaaagttgagtaaactgagactgtaatatttaaggttgtccaaggtcccattgcttttaaaaggagaactggaatttgtatccaagtctgtgatgttaaagactaaacttggccctttcaattcttggttgcaggaaggaagaaatgtccctttggtccgggatgatgggggcaggcttcacagaggataagggtgacagctgagtatgaagggagggtaggaatggaagggctctggaaggaaaagagtggcttccagatggggtaagtgtctgattgagagttgagatgattcagtcgattaaaattctcttttgcttacttatgcctgttcctagttgcataactttcaaggatgctagaataccaccaccaaggaagaaatgtggtcaaataaagaatgccttaagtgccaacggaaagactggtttggccagtgctgacgttttcacgcatgcccgcatgcacacatgaggatgtaggaacattatgtgtaagttgttttctggggaacagcagctttttattgtgacattcagtaatgtcctttctaatgtttggaattaaaatgaccctttctcaaatgatgatgataatagttaacacttgaatagtcttatttaatagcttaattaggttagcaagcatatgttgttggcaaaaaatattttttcctatgattggtccatgacttccacggtctggaaaacattcacgtgattgctgcatgttactatcagggtatgtgtgaggaacatcctcttctgttctgcataggtaagggctttccttgtgaaaagtgtttggcacttccaagctggctgccttataaatgccatgttgaacccaaattgtttgtactgagtgaccgtccctttgccaatgtctgtttccaatatggtatctttaggatataagtggagaataatctctttatttcacaaataggccccatcagacaagagctcgagctccaggtccttctaggggtcttcagtgaccacagaaggaaagaaaagctgagttggtcaatgccaatctttaggaaaattatttctaaaggtggcaagaagggcctagtgtaaaatatgacatactctgcctctctttcgtttgttcattttgttggattttagcacaatatgtatatatatattggtggaatatgaatgtgggagtaatcagcaacagagaagacttgggaacatggtagttatcccttcaattatctgctagagtaacatagatgaggcttgctccaggggcaccctaagatttgaactaggacttaaggatgaaagtcacaagtaggtaaggctgaggccaagttagtaacaggagcaactctggctaagtcagagctgtcagcaatggcctgggctccctcatacccatctctgacagtgttggtacaaacaacagaaggcaatgtcgagaaaatcccagggaaataattctaacaatggaggaatgatgtgactaaacacatgctttggttgggtttatttggattgcaagcaaaagaaactaattctggctaacttagcaaaaagaggaagtgttagagggatacttgaataaactgaggaaaagaaaagagctaacaagtgagctttaggagggtcagtgagaaagttgctccagtaccctcagtagcaggaaatcctaaacctttcttcagaagacctactgtttacagaataactttgttacaacctccaggcttaatggaaaaagagtaatgtttgaccttcctggaaagaaaatctgttagccccacctaggtcaatcagttatggcctgatttccccatcactagaaacacaccctaaataatgggatcacaccaaaagaaaaagggacagctatgagctgagggtcatcctaattggcagctctctaatgatcttacagctaaggggtctatttctatggtgtgctggagctggctgctagctagcgagagtcaattatgtgcatctccttccaactgacaagggtcagcctgtaccttggccatggtagaagtatttacacgatggaaattggcaatcactaccaatcagggattttgttttttctattgacctggtttaccagcgctctattggcctgtttcaagataattgaacagttttgccaagactgctgaacaagggacaggccatagagcctacaataggaaatacatagctaacacacaccagcacattttctgtgccaaagactataccattctaagtcctttatgtgtactaactcatttgagctgcacaacaatctaatgaggaaggtgccattatgttcccatttgacagataagaaaagagaggcagaaaggagtgaattaacttactcaagtttacatggctagtagatggcaaagtagagattcgaacccgggtatttataattttatgtctcaaaataaaatagattatgtctagcattgttctaagttgagatactcttgacacagaaaaaacagattcactttgaatcaagtgagaagttggctgaattccgataagaggaccaccccctcagtcacaatgctgccgtcagtaagagcagccgaccgcagctctacaactggtgctcggatgtttatttcatttgattgtatatttatttcatttctagggatgcccaaggactgaagccaaatcacaaagttgctaaccaagtccatggggaagagagagactcacaatgcacactgctggaactccccaagtgggtgacagcaatacttcagaactcggtgggcagagcagatcacatggttgctcctggatgggctgtgatttctcaattccagtgagaaaggggagagaagtctgaaccttcaacatacttccccccaatcccactgccaatactataaggcatagaaaacagaaaacaggggtaacatagaaagacagtcatccaattttatatatgtgcctttgacaagtcacttgactttacgtatcttagctgtgggaatctataaaataaaaatgatattacctacccccgaggtcactaagaggttcacagaagatcccccacaggaaagcatctggaaaactgcaaaaccccacaggaatggtgggcattactatcaggggcatccctactcacaaagctgtggccccctgggacccaaatggtgatggtgcaattggattcatttgaaacactagctggtatggacacaccatgtgctaggcactgcttctattgactaagccaaactcatcaagttggtgtaaaatcaccagtccgaatggctaatgggaatttcactggggcaaacataaattcacgaacggaaaacgactatctggaggaggcacaaaagagttttccttttccagtggttcattgagagatctgacaataatccattggcaagaaagagaatggctgcttctaaataaacttaaacaatgatcagtttttctaaatgcaccaaacttgcaattaatatttgttgaatcaatgaatgggattccacaaatctgggtttaaattctggttctgcaccactgccattggtgtgattttgggaaagctaattaactctttgaatctcagtttcttcatctgtaaaatgagaatcctaatacacttatgaggtattatataagataaatatgtaaaccatttagcacatttagttggttgtataacaagcagttattattattataaatgcaagctatagttattttttaccattactatgagtgtggttcattaagttattatcggctacaagataaatatgttcaaatcaccgatctctacagataagaaaactatttttttttttgagaaaactatttaaaaaaccaggagagaaaatattttattttctgttttctgtacttttatctacagattcaatacatttctagtgtttaccatggtatcacaattccactgccacaggcttaagcagatgtaaattggagagggaaaattaatttttcagataaatgcaaaaagaactgcattataaaaatgacagtgtaactaagacatttctactctagattttggcttccttttctttaatcacctagcaggattcttttggatatccaaactcaatatttcaacggctcttcagagccaaaaagctttctgcaaaggattaaagaagtagcaaaatgtcattataaatatgaatttaatttgcttgagaaaaaaaccctgcgtggctatgacagttatccattcttacataaaaaaaaaaatttaaatctcacaagagtaatagaaaaatatcaatgaactgctatgatcaaataaatgaaagtcctatcaatttatttgtagtttctctttgaactacaaataacagatgctaaatatcttcctttgtccattaaagaagtctgagattcttaggtttttctatcctaaacagcgcaacatgagccatgacaattcttcactgaaactgaattaatttagcttttagcttaaaaaagctaaagtatctataacccataagctgtactaatatagcaaaataactgtattgtattcttaagtgacagctgcattctttaggtcattccttagttaaacaaaagtggaggtggggaaggagacacagcaattgtcctgatatggaggcacaaattaatctccatttttatacttaaaaagtaattataaataaaatgctcacagtcctagtgattggctattcatcttcttttttttttttcatcttagccatttcctcaaagatccatctgcacttcatttatttatttcccccataaagagggattataactctcttatcccaaatttgaaatactggtttgtctgtaaatatggaagcctagaagaaaccacagtaattggtgcttttagctgcccacttaatcttgcttaagttaccagcattcacgatgaggaatgaccgagaggcacaggttgagtaactaccaggatggcaaatgcaggggatgaggttaataaagattattgtcaggaacctcagtgatactccaaagcatgagaaccaacaaatcacaaattaagagcacttgctaactagaagcaaggtgacagccaactgcggtagttaaggcattattgcttctgtaaacgctaagctcaagtataaagtagacatgtaatcttcaactccccgaacaccccaatttggccactaaagatgctgttttacatttccaaacattttcccctgtcactactttttatacttcagttctcaggttgtaagtatttgttacttgcaaagcagccccctttgaacactgaatcatgggaggcatttgtaactaactgccaatgctgcctgccaaacaaaaactccctgctggtgacatgaccacctagtgacctctaaaaatgttgtaacaatgtgaaaaatagctccctcttgtaggaaacagcaattttttaaattaaacgtacatcgaacgttcgcttatatacagataaatggtgttcagagtcaccttctctgtttccaatttcaatcttttgaaacccagcccaaacctaaataaataaatgttgatactaagaagaaactaagagctcaagagccttgtgattttgcaaacagcttttttccattttcgaaaatctaaactcggggccagacacagaacaggtaatgaaaaggaacaggcttggcagtccctctgtggttctaagctgaaaaatacgtcaggcagaaataagtggctataatttggcaggcttaatgtcttcaaaagtttgcagcttgctagagaaaaaaaaatttaaaacagttataacatttacaaattgaaacacagtcacgaagctaaaaagccagatgaacataatttaattatcctcagagttttaaacatacttttatcatcttcaggtgtttttgtacctacataatagaaggcgctgataattattaaaactgggggtaccaggaaactttttgatgctaacatgatcttaggtgactgtaatactgatgaacttagtctatgcccttgacatcaaaatattcttggtctcactttaaaaggtgcaatggagcttcccatatgtgccccatgggacacaaggaatgggaaattggacatgacagtaagtatttttgaggctgtggatcactgtttttccggttagtttatctttctaaaatttcaaaattaaaaatctcagagcaacagaagtatgacatgtcaaaggctgtttgactctaatgtgtctcttgttcatcctgacatcttctgatgaattatttccaaacactggcccaagccatgaaaaatcaaatcagcttgaaaacaaaggggcaccaacaactgtctgtttctaagccattaaaatgcctggaagatcactctttttagaaagaatagtcagtcctttttacctccttaaatctttctcgcctaccaccccatccccttcctctgtacccaagacaaagaaaaccaccttaagagttccctccctcaaagagggagaaaggaaacgtacatgcttttatctctgattttaaaaaatgaataagatgcaaagaagaaaaaaaaagtatacccaaatccacgttaaaatatgcttctaccttttcaaattttagcttaaacccactttgctaatatgctgatataccaaattcaatatgcttttggtgaaaacactccatgctgaactaaaaacttctccctgaactaaaaactactccccttgaaactatggtgtatgtgggtattcagaaaagaacacagaacaccacatcatattagtgtataggcatggtaaattattgtcatttccggccaaggagagcttctctgttttgtgacattccccagctttaatgagcaactctgtaatatgtaagttgttctggaagacttaacatttacaaaaaacacagcacgatattacttagcataatgtaaatttggaattttaaagaaatctgagaactggaaaaggatgtcccttccacactggtctctctatctcaaatttttaggtgaggaggtgagtattggcaatatgatttgatcagtgctaaatccaaatttatgtaataaatcattataataaaattatactaggtggacccctgtgaaactgccagtgtctgggtatgttcaacccataaaaatgacaatatcataagattcagcttaataacacagtgccttactttcttaatctactaaataattctaataataattatttcacaggattgctgtgagaaatcaatgagatactatatataaagagcttaacacagtgcttgacacatggtaagcattcagtaaattaatggagtaggaaaaggaggagttataaacctataaatattgttcactttgaacatcctaataatttaggttattaccacttacataaacataaattatttatcaatagcttacaatttaagaaatgtaatcaaaattcttagtgagtattaactgttttcactcttagatcattaaaagtcaattgtatttgaggctcagataatattcctcttggaaaaaaaattctatcaaatcaagataaatatcatatatatatatacatttatacctctgagttcttattttttgtattcaaataacgatagagcccattttttcatctggagagaattacatctgatgactatcagagtgactgaaatattaatgacttaaaaaaaattcacagctatccaatatttcccagcaattttgtgaattgtgccaggtgattccaataatctgctattctccccaaaaataacatggattgttctaagtccatgaagaagaggcagagctcatatttcatctaaaaatcttttgtgcaaaaagctgtatctacgaaattattaatttccaaaggatggagggactggaacctgtgactgaggtagtctaggactctgaaatgggctaagccgaatcatgagacttgggttccccaactccaaactatgcacaccacagccaccccactcatactgaggaagatcccccaaactctgcctcttctcatttcacgcttttccagaagttcatccttctcagaaccacttcttctctgacgggtatcaccaaaggtgaggggcagaccaatgaggaggagggcttgctgccatcctgcagagcctcccagtggccctatctttggcagtgttctaacttttacagatgcctgtccccatttgacaactttctaacttagatttccttgtctcctaggacatcgctagcctacacgccaagggctggcgttcagacaaggtgggtcatatctgtagccaaaaaaatccagccatttaatataaggaagtgtggatatgggatctttcccctcttcttattacacattaaaagccaaaccaactccctgcaaaaagctcaaactgcgtaacgttttccaagaaggttatggtgggtttatgtcaatgaaggtgaatggatcaaatacagtcttcagtaagatctctaccaacaaataaggcttaagcatattaaaagagagtccattttgggaattcaaaacacttggattgctaaggtgagggttaaccgctaaattccaccagataaggtggtttttcctttttctttttagattacagactctgactaattcttgatatttttagttctttgcagaggaattttaatttggaataaatttttactccttgacaattaagccaaacttcagaagcaactctgttttatgacatttcagcctcccccagtttacctatctgtaaaattcctccttttgtaccaatccaacagagcataaattaaagcacattgcaaatggtattctaaaggaaacagacaatccctgaattggtgtattgctgtgcatttcttcttgtcattttgaaaattacaatcatcttacaattttaaaaaacagctttctagattcttcgcaaatacaataatatgactgctccacagttcacttaaatcactcgggtttcacttcatcttctccacatttgcacaggaagaagtgttcgctattgtctcctccccctctctgggagtcagaccagctgggacgttttaagtctctttcattaaaaaaaaaaaaaaaaaaaaaaaaaaaaaaaaaaaaggttaaggtcaaaataagtatgataaacatggtagtttccattctcaatattcaaggacgaaagactaaacaacaacaaaaaaatgtaacattaaaattcactgaagtatgatgaagattgtttttttcttcccttgcaacataatcatggaggaaaaaagggttttggaaaacagcaggttttacctttagtaaatctagtctttcaaatgagtccagtagttaattttacagctgcacattccttaaatttatatgtttccaattatctgaatgactgacactttcaagttttatggttgattttgaagagcagggcacttaaacttacatgaagtagatttttacacacatgagtaattaaattgtgcttaacgagctcttctttgtacttgtgaagttttagcattttggttgaagtttccttaaaagttagtaaattccaacactggacttttcataatacacactttgctattgggcttaaccttttttacttacagagtgtcagcacccctccgtgacataaaccccctaccaaacagtagccagtgtcaaggttatcacatgaaaacagaccgtaggtttcagtctcgtacttttctaatggctgaaaaaggcaaattcacagcacggacagagtaacacattgacatcaaagaacctgtaatatcacaggtaaattaatgtgcttcccactgcctatagtcaaggagcaaactggattcttcagaaacacattctgaagccattttatcttcccatccccttcttccttaaatgtaatcgtctactgtctgtaatgtaagcaaatactttagtgaggttgtgaaaaattgattaggagcaccttgaagaccctacctccgtgatatttttttttgtaatagttacatgggtcagctctttgatatttgctgcatatagaggcagaagtattccttcactttagttcagaaacacttgaaatagactaagtagtaaaaattagttacatattccagttgctgtttaatgcattattaaagaattttcacatatacattggtgagaaagatggctgaactataatgtacaattaatatgttgctttgccaagagatgactggatcacaacagtagagaaagtcagaagatcaccctgaggacatcccaactaaatgctcacttatcactgaatctggctttccacggggtgtctctgctagtctgcatggaggtggttcagtgcacgtgaacacgccatgtacaaataacgctcagataaaataatccagaaataatatactttttgacacatataataagcatatggagtcagttaaccaagaaatgaaatacggcaaatgttagtgggtcaggggtgccttgatttgtttctagaataggagagcctaaagggcatgacataaacctgtggaaaaagaaaatggtaagatgcaaatctccctctgaaaagagtaggtgggcccagggtagattgggatgtgccaaatgaagacacagagatgtcctcttaagcatcaccacttgttcattctgtgatgcagagcctgtgtcaacattaagacagatgctttgaggatcaaataatacaatgcattgacactgataatacaaacgaaaggagagtggctgccgttatgatgtttagtcttattccttgctattcctaccatcatcattgttattactactggagctcaggtcccagcaaactttctataaaaggccagagagtaaacattttaagctttacatgtacagttgtttcatttatgcaaataaaaatacaggagttcagttacatttcaatttcagataaacagtaaatattttcttttaatacaagtgtgtcctgctcaatatttgagatgtgcttatactaaaaatgtattcgctgtttatctggtttttttttttcttagttttatctcaggctttccatgtgttatctggcaaccctatttataggccatgggttttctgttgcagctacttgactccgctgttgtagcgtgaaagcagccatgacagcacataaacaaatgcatgtggctgtgtcctaatgaaactttatttacaaaaacagatgacagatgaggtgatatggtttggcaatgtgtccccacccaaatctcatctatataattgtaatccccagggagggacctggtgaggggtgattggatcatgagggacacatggtagtgagtgagttttcacaaatctggtggttttgtggcgggcgcctgtagtcccagctactcgggaggctgaggcaggagaatggcatgaacccgagagttggagcttgcagtgagccgagatagcaccactgcactctggcctgggcgaaggagcgagactccgtctcaaaaaaaaaaaaaaaaaaagtatgtggctttcttttctctctctctctgcccccctccctccctcccttcctctctctctccccctccctccctcccttcctctctctctctctcctgccaccatgtaggatgtgccttgctttcccttcaccttctgccataattttaagtttcctgagggcttcccagccatgtggaactgtgagtcaattaaacctctttccttataaattacccagtctcaggtagttctttatagcagtgtgaaaacagactaatacacgaagataggagttggcccatgggccatactttcctgactcatgtcaaaggtcaaaataaagcctacactgagttaaataatcggatttaatgtaaggatggactattctaaacatttgaagggagcattttctttcatttggacaaatagggtaaattttcaccactgcctggccacaattcctgggtcttcctgtctgctaccttgcctaggaaaatgtttctgacactgcaatgcacctgatattgaagccactgaaaatcaatatttgacacatgtgtgttccaatatcataccacaacagacacacaaatgaatgagactttgtgcctgccttcaaggatctcccacccaggtcaggagggtccttatttttattttttttaaaaagtaatattaaaggtaatacatattgtaagctagttagttgggtcaagcaaacccttggccaaagctggtagaagaaacgaagggacccagaccttggctgaattgcaacttgaaggcagtgtggctcagtcttactgacagacccatgcactcagatgggtaacctgtatcacaaatacggcaaaaaagcagagtcaaactggggatatttattcaaggaagaaaagcctacaaaagagagacgcaaggaagaatggctgaatatttgattgtgtggaggagagacctaacttactccatatagtttgcaaggacctgaattatttcacatagctcaagatgacagaaccactgtccagttcagttcaacttaacaactgtctacagaacacatactaagtaggtaggtgaaagcctggccccacatgtacattacaatctagttggaatgatagaggttaaatacataattaaacagagaatcaagaaagagattcctaagaaaatggcattattggggacttgaggaatgacttggatttggtctagaagaaaagggtgagaggcagcctgtaggcagataggaaagcactggcaaatgctcaaagcatagagcttggcatgtggcaggaacaatgacaagttcaatgtggttacacagttggaccagaggaagaattaattgtctcccagcgatggtgatgagacatgaaagcgtttaaactaattattaaatagtattgattttagagaggtggaatgtggcttaacttatggaacagatgtctagtattgctagaatgctgcccattcacagaattttccaacaaggaagcaaatggccatcttgagtgagactatgaagaaaattcctgctctagagaggaggttgcattggtgagatagatgcatcgggtgtgtcttgcattaaacaaatccagattcagagagggactctgactcctgccaactggtgaccctgagcttcagttctgccatctttaaagggggatagttactgattttgcagggttgttgtgaaatttagaaatgagtaccaagtataactgtccagcacatagaagttattcagtaaatagtatagacacagactttctgactttaaattgtggacattttcaaatatacagaaaaggagaagcatataatgaatgcccacaagcccattacgaaaatttaataaatgtgtcatattttctcaccttttatttctgaagtatttttaaagttggacatcaagacattccacccctaaatatgtcagtctgtttctaaaaattatggattttccctatataatagtacctaataaaataaagcacaatattacagatattttatgcctctttttaaaataaatgttggcttctcacgacgtatttttatgaatattattttagtgcattcactaactctcatgcagacctacccttttcaatgttttaaagtcccccaaacaagttcccaaatattaacattctcagaaatacttccactgtttgcgtttctgtatttagttcagaataaggttttgcaatttttctttttatggatacagcctggggtgcactgttcagctacaagagttctgcagtgctctccaaattttaaaaaagtgtttatctctctgaagatggacaattttaacttaaattatttctctgcaacagccataacagatgaaaagcacatttgcaattacttgccccatttttaaaccattttcttcttaggcaatttttgcttccaggtgagcataggccattctctcctcctcttagaactggcttctgtcacacctgctgcaacacttgcatcgcatttacttactaacgggatcttttaccttggactgtgcacacagggcctgtgtcaatcccagtccccagtccccagcccagatcctggcaattgctaagccctcagttaggtgttggctgaatgactacacaaatgaaggagatacttatggctttggctgtgctcttattttgctcatcaaatcttccttttccagacagagaaaaagcaaaattctgcttaggtcgtaggatcttaaagtctgaattaacaacttctaaacaaatagggttttctgatagttttctatgcatccttaagacatttgacaattgttgaatgaatccccacttgtatttactcttatacctcccaagaattcatgagaccaactgacactcaaggaaatctagaggctaaatatagagacatggggcctcctttcacctgtttcttaaatgagaacgttcacctccattgcatgtagcctaatgtgactacgggcaaacaacagaatatgcagtggtgaggctcatttttggtggggattttcttctttttttggcaatacatagggtgagatttcagctgccaaattatacagctcttcaactctgtgccaaactttatcaatttcaagagtcacctattagaacaatttctaagagattagttttaatccaacaggagatcgcttcttgtcttccaatgtcagaaaaataggtcaaaactgagtctcctacaagtccacatgatctatttctttcttttcatttatttattttttgactgaataaaactggcattcctaagatagagaattcagaccagggcccatatgtgactgtaatatcctcataaatcaaattatgcaaaatacatgcaattatctacattacctacttgaataaaaggagacttttttctctccaagacccaagaatgatctgaagtctacttttcttggcagattaaattgcccatccatctccagccattggtgctcgttcaaacaagtaatggctctgcaaaggctgatcctaaagggtccccaaattcatacttaatctagagataagtgcagcaatcaatctttcccagggtctaagagagctattgtattccacccaatgacgtagcatgtgcaactattgttatggctttctgccctaatgactcaaaatgaacatttttagacaatccaaactggcagaggtatcctcaacagagggaacatgcttcagagagttgagtgggtcgttacttgaggcttttttccctgaggttgagggagcagctgttactggggctattacatcatgcagatacgatattaatacgaaacactgcaaagtttatctttaaagatggaccgcagaccagactaaaaacctgaggaaatcttgtccacgtctgtaacgtctctattccctgcctgctcaggtgagtttggctttcctgcattttgctgaataaaatgattacgtgatctcactgtctgttttattcttcttcagtctcaaaagaaaaaaagaaatcctaatagaatgagagtgagagggcagtagagtagggtgcagtcttttaaagagaagtcttttaaacatggctcaaggatactgtactccaaattgggggaagaatctgctgaggctcagaacccctgtagggtatgcctgggccaagtcccaggacactaagagaactgtgtgaagctaccaaggctgccaggaggagcagctgaattcaaagcccaggccacacacagaagcactaaatgccagcagatcgccaaaacctgctgtggccaagggctggcaacagaaggaaagctgcccatttggagagggggcatctgcccccatttaaaggctagaacacaactcttggttctctccacaagaaaaaaaaaaaaaaaaaggatcaaggacccaaacaaaataataggggaatagacgtatcagtttgtaggtgatttattatttttattttatttatttattttttagatggagtctcgctctgtcgcccaggctggagtacaatggcgcaatctcagctcactgcaacctccgcctcccagagagtgattctaattgaatccaacaacagtatgcaagctttcctgcccagccttggaaatgacccaaggagactgggcaggtttggcatttcaggtagatgtagaagaaaccagaccggagctcacccctaaaataatgatgggggaagagggtgagtggagcttgtgggatagactgaagacccaaaaaggagggtatctagtagggggcactcaccctctggccccacctcttatgtctggcacaggttgggaagggctggcaatcttgaagacaccaggaacactgagatgcagttatggacacagctctaggactataacccagaattcaccttctctgaaagcccaaatgtctgagaaaaaagagctgccaaaagtcacattgcattcctccttcaccttcacacctccacttcctggaacaggaatcctgagggtgattacttgcctgatttcccatgctacctagtttatcttccctcttatcatgttcttcctgccacctgtgtttcccaggtcatatcaacttgggggttagagaagcctaattcattcaactaacaaatatttattgagtgcttactgtgtgccaggtcctgtaacgggcatcagtgataaaatggtgaacaaaactaggcaaaggtcttgctgcattcatggatttatgacttaaatggcagggaggtgctgataccagttggagaggtgctaattcactagtcatgcagataaaatgtaactttagtgttccagtggcataattagttagcatgcagtgcttataaaatgtaaattgctcagcgggcttaggtttttgccaagggtgccagcttccaagtcactactacttttttccattgctaacatatctgccagctccaaagtggcatgtttcagatgttctcaaagaccccagaggcttcggcaaggccacctattcagtttccactggccgtcttaactgtgggccctttgctttcaggccaagtatgagggaagtaaaacagaaacccctctgtggacagacgcccagctccactcggagttactccttctctctcaacccagtttccctaaggtgctttaattcccaggaggcaaggtggtccttcatgcgtatagacctctaagaagcccgcctaatcagacatgcccaggtagatcaagactcagcttaaactagagatggcacagagaccctcctgccagctctgctctgtaggtgatgttctccgggagtacactaaagggcatcagggatgaacaacaaataactgatgtgaatgagtgatgtctgatgtagacatgaaaaatgaagtgttggccctatgttcaagttaagctatgaacgttctcgttacttattcaacaaacatttgggggtctactgagtaccaaatgtaggatggtgatatggtttggatttgtgtccctgcccaaatctcatgtcaaactgtactccccagtgttggaggaggggcctggtgggaggcgattggatcatgggggcagatttcccctttgctgttctcataatagtgagttctcacaagatctggttgtttaaaagtgtgtagcacctccttctccactctcttcctcctttttctggccatgtaagatgtgcctacttccccttcaccttctactatgattgtaagtttcctgaggtctccccagccatgcttctggtacagcctgcaaaaccatgagccaattaaacctcttttctgtataaattacctagttttaggtatttgtttatagcaatgtgagaatggactaatacagatggaaagaagaaagaaggctggtttgcaaatcagaacatcaatcctggaataaagcactatctgggaatccataagtcagtgccttcacatccatcgctcattcttccactcaagaactacttaatgatcaccaactctgtaataggcactgtgctttgtgatggggatacagtggtgaacacaaaggactaggttttgccttcctgaaattcaaagtgtcataagagagaagaacaataaacaagtaaaaaaatgaaacttcagataaagacaatctaaaggaataaagggacaaagagttacaggggagagggtatactttagctaggccttcctgtgaaggagatgtttgaactgagccctgagggatggaggacatggggccagctaggggaagatcacaaggaagtgcagaccagatgggagaacgctaagtgtaaacgctgtgaggcaagtatgagcttagaagaagcaagccaatggggccggagcttaggaagacagaagaaggtgacatcagatgggtttggggagtaggcagcgggcagcagcaggttacacaccctagttgggggttgggttttactttagttttatgttttaatattatttttgcctctgagcatgcaatagagggaacagacatgatcaaactcataccctaagattatccctgtggccactgtgtggatagatcttaggacgggagaaaaatcagtaccacagtgtcctcatctgtaaaatgagacattggattgcatgggctctaaggtccctttggctctgaaattttaacatctatgatgaactgggatgagtgttaggatcacagtgagcctgtctgcctggttcactgctatctcgcttggaggcctccgaaggctccagcatacaaaggtggctggtaaatatataccaaatgaatgactctgattttcatttacctaagacttgccctcttaacattaaagaagtctgtctttttagacctaagtggttatcatcactgctgatgaggtcaagtcattcaacatttatttgggggcagtttgggagctgatagtgaaccagcctggattaagagctctggggcacaccaggttcttctccagtagttttacattcttcagggatggcctcttttccctccttgctgaacctatttctgagcacatcttagggggaacatcacagggtctctgtctgggttgggcagaaggtagaaaaggtatatacaagcagaggatgcaaaggtttgcaggttgagaatgcaggatattgtcagacgatgttagataatgaattcttcagttctcaggggataaaaattataaatatatttggttgaacaattagaaatttctatcttttcagataaaaaaagttgaatatcagcaatttcattgggttcaatctaatgtatagtaaccaatatacattacatattggttactatatctgagtgccataaaagacggtattcatccacaagccacagagtgtcacacttcatcttaaggaaatctaaaaacacttcactccaggttttggaaaataactctgaaaacagctaaataaaactctggaaaggcaagtgaatggaaggagggggatatggcagaaggttcttgtggcagatcatgttgtcattcacaattatttgctccctgcttccctctaatagcagccaacatcccctccctttgccaggtgatttgcaggccttcctgtaggaaaagtacacttccttgccccatcgtcaggcttggccatgtgatctgccttgacgaatgggatataagagaaagtaatgcgtgcaaactgcaagcagacactttaagagccattgtatgcttcttctaactcttttttctctgccaggagaatggcatatcccaaacagaggctgctacctcatcctggatcctagagtgatggtgacatgtagagcacaagcacagaccccagtgacccatggctgacatgcaaccactgagctgtaggggtcacttgttatcctccaaagcccactaatatagcttataaacttgcagcctccaggccacatcagaaccataggaacattgtgtttgacttgcatggaattttaaaaatttatttttttagtcggttgccaaaatattaaaaaatcccagtttgaggctttctctaacaattggaagaattggtaacatcagagctgtattcctgcatgacagaaatcaactggaacagaggagtgagtgcccccttccccctttgatgggcagatgctctccagccctcactatttcctaccatctttccaactctgaatctaagagttggttgcaatttatcatcactgttaaactgttggtttttaattttttaatttttttaaattatactttaagttctgggatacatgtgcagaatgtgcaggtttgttacataggtacacatgtgcaggtttgttacataggtacacatgtgccatggtggtttgctgcacccctcaactcgttatctatattaggtatttctcctaatgctctccctccccttgccccccacccctgacaggccccattgtgtgatgttcccctccctgtgtccatgtgttctcattgttcaactcccacctatgagtgagaacatgcggtgtttggttttctgttcctgtgttagtttgctgagaatgatggtttctagcttcatccatgcccctgccaaggacatgaactcattgttttttatggctgtatagcattctatggtgtatatgtgccacattttctttatccagtctatcattgatgggcatttgggttggttccaagtctttgctattgtaaatagtgctgcaataaacatacgtgtgtatgtgtctttatagtagaatgatttctaatcctttgggtatatacccagtaatgggattgctgggtcaaatggtatttctggttctagatccttgaggaatcaccacactgtcttccacaatggttgaactcatttacactcccaccaactgttggttttttaatacttgattcaatatagatcattcagattacaaattatcctgatttaccttaaagataaaatggagaatgacattagcaacatcgattgtgctaggtactaggtaccttatgtgcattatctcactgagtcttcacgtccaccctgctaccattgcacagaaggggaaactgagtctgggagcccagagttagacaaaagttagtaagaagtaaagctaggacttgaacccaggtctgtttatctccaaatcccatgctcttaacctctcttgtgacttgttcgtggtggaaaaattagaagatgaaaataagcagaaatgctgaggcataaaccccactaggctggctgactgcaggcacaaagcatgagcctcctaatcaaactgggcttccaattaacacaatctgtcaaaacagcagtaactcttgctcccattgcactgaggcgagataattaaccctgcacacctgatgagactgtgccttcttcagtacccactctgccccacagcaggcctgaggaggcaggctctccacctgtaatgggaaataacctttgcacagagcacacaggatgtctgtaattatgggttttctcagaaatctcaactgtgtctcaccttttgctcctatccagttgtaaccttcacaaacaaccactcacttggaggggtgaaatatccatcagcgacctgggagcaactcataaaggatctgggctccaaggcctcacgtctgtgggcctctccgcccatcaggactgttgtgagtattaaataagaaaatccatgcccaaaggttagtatggtactctaggcatacagtaaggcattaatacctattcttagaattaccatttattttattaattaatttatttttgagacaaagtctcactctgtcacccaggctagagtgcagtggtgtgatcttggctcactgcaacttccgccacccaggttcaagcaattctcctgtctcagcctcccaagtagctgggactgcaggcatgcaccaccacgcctggctactttttgtattcttttttttttttgagacggagtctcgctctgtagcccaggctggagtgcagtggcgcgatctcggctcactgcaagctccgcctcccgggttcatgccattctcctgcctcagccccctgagtacctgggactacaggcacccgccaccacgcctggctaaattttttgtattttttagtagagacggggtttcaccgcgttagccaggatggtctcgatctcctgacctcgtgatccgcctgcctcggccttccaaagtgctgggattacaggcgtaagccactgtgcctggcctattttattttatgttaatttttgaaaaaagtatttcaagttatcacccatcctttccctccctaagcttttatattcatcagcactgagcccagcatgctggaattgtcaaatttgccaagatgaagagggtcccttgggcctgaagcaactcctgctgtagttaccctgtcttagctaagggtaattctattcttcccatttctcagacccaaaactttagtgtcaagattaatagcaccacaacctgctccctgcccctgtacccacatccaatccttcagcatttcctgttggccctaccttcaaaataggtccaaagtggaccatgacgcaccaccccactgccaagacctggtggggcttgccatcatctcatgcctggattattgcaatggcctcctagctggtctcctgcttcttttctcaacacagtagccagggatcctgttaaaatgttacattggagcaagtgattcctctgctcaaaaccttcccaaaggtctctgcatttttctcagagccaagccaaagtcatcccaatggctatcagtcccgtgtgacctggctcctaattacttgcctaacgttatttctactcatcctccaaccatcacacaggcttcctggctggtcccaccttagggcctttgcactggccatgccctctgcctggagcgctcttccctctcggacatgcacttggctggtttccttactccttccaaactttgttcaaatcttgccttctctatgaggtcttttcataattaaaaatttgtgatcccaacatttcagattcccttttctgacttcaaatctttctctttaacacttatcactatcaaaatatcatatgctaggttaaatcatacacaatttcctatttttaaactttttgacctatccacatgccagtttcatatgagacaagctaatactcatcttgcctgtcttattatttctcccttgttgagaatatcagctctatgaggcaggaatgttggtttcgttcccaccatccggaatggtgctgcgcacaaagtaggcccccagtcaatggttattcaatgaatatggaatatggcacagtgcttccatttcaatttgttttttaaaaaaaatcattgctgacaggtgttcctgggaaaggctattttggttagaagtatcctcgccttcttgcaagtgcacagagaaaaactgtaagtatattttttggttcactgaacacccaggatatactgaaaggaacagagattatagagggaaagaaggcggcttttgtgtatatacttatccaatttgagattcttgtcattttattctcttccttccccaaatttgggttgctacccctgtctgatgcccaaagtattctaaccagaaggcccataatcataatctttttgaaaaacatccttctggctgccctgcttaagctcagagcagtaattaaccccaccgccttctgagacctggagcaccctcattcaacacacacttttaataggatacattcagtctcaggctagactgggtaaaacatggtccttactgaagggaaagaggagacaatgggccataaccacatagttcttagtggtccaaggaccacctaacagggttgggaagaaagctcatgggatctcaggcagtgaggcattatgtcaacatcggttcaactaacaagctaagatggattctgcagcccaagctcaagtctgtgtgtgcatttagacactggggaaatgaacttccctgagctgttgcctggagcaggatacaaagcactcagggaccccccgacttcgtggtctcccatcaatgttatgatgctgcaatcttccccctttccttggctctcctgtttccctggtcttgttctctgggtcctgctctctaggtgttccagtggtttcccaaagacctggtttacaaaaggaggcatttgtattcattctgcaggtttggctttgcagagccaggccttcagaggctcggatctccttcagagccttggctgtcagcctgggagaacccaccagattacccaccaggtaaacaggatggcctggcccttttgggtgacccaggcaggctttccttagccttggccagccagggggaacataatatgcctttccagtcaatttcctttattttccatttaaaaagaaagtccttcatcaaaataacaaaccattaatattacctaattactaatatttattttaacatggttaagagaatggcacgttttacaagtattagagacataaaacacaagcccaatttggttcttgcctcattaaactttaaattgttacagttcactgcttacaacaacactgattctcactcccaggtctaactaaagaacaaattttaattcaatggacattttaggagagacaacagccttgtgggagtctttccacagcagaagcaggagcccagctagcatcaaatgtccccacacatgtcctcctgcctttaatctccttaatcagctttccaactacccaacttcaggggaaaggccttctttgtcttcaattttctgtttcctttttccttgcttgcttgatgatgataaagacatgagagacagaaaaagaaagagagagtgggggtcgggtgtggtagctcacacctgtaatcccagcattttgtaaggcctaggcggaaggatcacttgaggtcaggagtttgaggccagcctgatcaacatggtaaaaccttgtctctactaaaactacaaaaattagcctggcgcggttgtgcatgcctgtggttcgagctctcaggaggatgaggtgggaagatcacttgagcccaggagaatgaggctgcagcgaactatagcagtgtcatggcactccagcctgggcgactctggcagaatgagaccctgtctcaaaataaataaataaataaataaataaataaataaataaataaataaaaaaggaaaaagtgagacagacagagagagtaaggagagatagataatagacagacagagagagtaaggagagatagataatatgaacaaatgagagaggatgagacagaaaagatactgagagggccctgccctgtcttgaccagaaaaatccaatgagaaaatactttcccttcctaatcctctgatttttacaacagcagacaattagttatgaatccaaaccaacttttccctgcgaacttctgccagttttgagataatttgctttgtttggtgtgcagcaggggtggacccagttggcttccccaggggcagtctgtatgtcagcaacatttgcataatccatctcctcatctggccatgagctgtgcaccacaggagaagaaggataaagaaagcagtttggtggtgatccacagaccagtctcactgagctgagacagaacctatcctcacctttaggctgggcaagagggggccctactgtgaaggcctgcatatcaaaacaccaacacatacttttttttttcttttctggctctttagaatgttatttgttgttgttgttgttgttgttgaaagtttagtaactgaccaagtgaactggaattataaagggcacacaagccacacggggcctccatttgtcctattgtcctaggtcctggaaatctcaagaagcgggtctgtctgcacaccatggagagaagataagggcagaaatgatgggggagattgtcatggagagcacaacggagtaagaacagactgaggatttaaatacttaggtacataatgtgactaaggatggagcaggtctaagtgagagagaaggctaacaccatttcagggatggagcagggaagccgctgagtggagacgatgggactaagaaggagcaggtccagggattcactaggaacattcttgggaactcgagaccagaggagcttaggaaaaggataaagacttacacaaagaaataggcgtgagttactcatgtgagcctgggggtacggaaaggggctgggaagggtcaagctgtgggacagctagacctgggttgaaatattaactccagaacatcctggagattgggagctggagctggtggcctcaggcctttgacctagatctctctaatcctcaggaccttgtaaatggtagccatcccaaagggctgctgtgagaagaaaatgagaaagctcatacagtggagtaacatagcacccaacatggcaaacacacacaaacgctaggcagtgtggttggcattagcattcattttagtattagtattcgttgtagtttttccgtgaatgtgattccatttggctgctcctgctggaaaaaacacgggagacatctacaacttcctcaaccccaatcttttctggaattctcttgggaagactctcttcttgcttatagaaccaagtgtctccctcctctctttctccttctcaccccaaaggcagttaaaaatacataaaaaaaaaataataacagcaatatctggcatctcaaaaaggaacatatgatttctcctcagggacaaatggccttgccaggcagaggcacctggcaccctgtggatcatacctggtgtcaatattccagttagtgccagggacatctggcttcagtgtggcatctgagggcccatgtagcatcaggttctggggtaacaacctgcagaaagcagaagtgtacccagctagagcaggaaaaagctgcaactgtgttacagtgaaaatgaaatttcatgtggtgctctacagaagggctaaagatgggtgtccttcacccacacccaaggacctacccctcagaccatctctagatagaaagtccagaaacaaaagtgggcatacaggcacccctgtgggctggcggaaggagggaaaagggaggctttgtgtctaatctgaacttatttattgtcagcctccagctccattagaaatgctgttcattacccagaaagccaaatttgtgtgagttaatttacaactgaaagatgtaatgttatggagtaatctatactttgatttattgtaaatttcctactggcatgaatttttatacaccaggctttagctgatccccctaaccgacaaataatgcttgacaattacacactatcaggcaaacatgctggaacatacacttttacccctaatcctgtatataaattttactttttacacttgtgtggctctcttccacatgggaacttcagaatactgtgcccatttagtgtactgtttatcaagatgaaatgtgaccgaattgactatttcctcaatgaggcaattctaaaaaaaattaattttgttaggttttttattttctaaagagaaacaaaactttcagaccataggaaatttccttgatgatgcttcatatcagattaggtaagatttctgatgcctgctgttggctgacatgatcctttttcaatgaagtaaatccaaatgctcatgaaaaaaatatatttaaaaaaatttttttcacaaaagggattttgttagagtagtacctatgatgtaaatgcatatgcttatgtataactaaatgaatacacgtgtgtatgtatatatgtaaatgcacacaagattggaaaaatgcaggtgttccttaaatcctcagagggctactggagaaatcaggttctctggaaacatgacttgggtaagtccggctgtttctaagactctacttttggcacttttataccacattcagagtggtgtggtaagaaaacagaggaaggaaaggaggagggagaagaggttattctgtgtgtctattccatttcatgtatttcactagacataatgcctaattatttcatttctcaattttattttcaaactcttggcatggggaggtcttttcaaaagacaggaaatccagatgctataaaggaaaagactgggattcatataattatgaaagttctgtgtggcaaaaaacagctacaacagcaactccctaaatgagcaaagctgtaagataaatgtcaattagataagcacatttcagataaataatttgcatccacaatatgacacattaataagaaaaaggtctatcagccagcagaaaggtacaaagggtatgtatcattagcccatgcaaaggatatgaatatacaaagctctgaataaagacatgtgaatgactaattgataaaggatgttcatgcatacaaataattaggaaaatgaaaagtaaaacaacaacaagtaaaacaattaaacttcttggaaagtttaatcaaggagaaaaaggtggagacagaatgtaaagaaataactataaaatgacaaaaaggcaagggaatagaacagataaagaagagattggaataatgacaataggcatataagtagatgaaatggacaatactctagcaaaacaaaaataatagggaagaggcagataatctaaatgggccaataacccaataaccaggaaataaaaaaaaaatgttgccaaaaaattatctccaaaaatggccctgggtttggagcatttaatagaagaatactttcatactttcaagaacagaccaatgtttttggctgcttaaaaagttctggaaataggccaggtgcggtggctcacgcctgtaatcctagcactttgggaggccgaggagggtggatcacttgaggtcaggagttcaaaaccagcctggccaacatgatgaaaccccatctctactaaaaatacaaaaaaaaaaaaaaaaaaaaaaaaattagctgggtgtagtggcggtgcctgtaatcccaactactcaggaggctgaggcgggagaatcacttaaatccaggaggtggaggttgcagtgagccgagattgcgctactgcactccagcctgggtgacagagtgagactctgtctcaaaaaaaaaaaagttctggaaatatagactgcttcacaatttaattttcaaagctgacgtatcttggatacataaaagaagaaactgtaggtcaattctacttgtgactatgatataaaaactgtaagctgcaacacttgcaaaaaaaaccccagcagcacattgcagaaagaatacaaacacggccaagtagggtttatttaaggaaagtaatgatgatttaatagtgggaattccataatctaacacattacgttagtaagtcaagagaggtaaatacatatgagatcattcaaagcagttcttctttatcagtggtacacatcagaatcgtgggtctgattcctaccacggcaaattatcttacagtgtaactggagaaagtcttagtcttttttttttgttaagtgctctttgggaattcttaaatataccttagtttgagaaccactgatttagaagaaaatgttcatgaggcattaaataaaaattcaacaattcttgatataaaatcacaggaaactaagaataagagcatatctctttaataaggtctatctcatctgaataacaaacaaagaaatagtgaactacaggcaacattcccatgaaatccagaggcaagacaaggatgctcactataaccactagtatttagtattgttttagatattccacctaaaacaataagacaaggaaaacatactaaaaccgctattgtaaaagagaagcttacctgggattattaacatatgatatgataatctattcagaaagtacataaaatcatgaaaaagattccatttcttttatggaaaagagtcaactaaaaaactacttgaacaaaaaataatgcaggaatgtgtcaggttaaaaattcactaagctctacgtcaacctgcactgccagttaaaaagacaatggaaaaagtttccattcataatagctaataggtgtaccaaaaaacccacaataaatagacataacaaaaaattatgagttccaattttataaatatcaaaaagggaaaaaaatcatcttggaattaaaaccatgcaataaatccatacaaataacatattttttaaaatctccatcataacaattgttatttactgagtatgtcacatatgccagtctttatgtggaaatgagcattttacaagtgcatttctttttctattcagaaaagttcactcctctgtggcacacgccaatattatacttaatttacggatgtgccttttgcccaaggtcataaagttggtaggtggcaaatcctgtattcaaattcagccaaatctgccatgctcttgaccacagctctgtggcaaatatctcctcccaccagggcatctgattctgtagccctgtgttgtgtgatagcaaatgatacgccaagacgagctcactcagcttcatagggtcaaaacctttccacatcactgtttattaaaacgtcctaaatgaagaatagcaataaagggctctgaaggaagctatcagtgacatccggggccttagcgtgtggtatgtcacccaaatacatttggacattatatcatggctgttgttttgggctcttgcccaaaactctgtgtgagacctcagacaaggaaggctgtctctgctgcactgagcactctgtcaacactcaaaataatgctgaggcagccacagcacaatgcaggaagggatgtccggggccatgacatcttgtagaggacaccccatatttatcactgtttcaagttcagatctgcatgagcaactgaaagcaatacttggactgttggaagaacaagcactgggatgggaatgagaccctccagccctgaaaccacaggccctgcccaccagccctgctctccagggtaggtgctcagaaaaccttcctggacttctccatatgatcctaatggaagcctgggggaagaaacatttgtcttctgaattttcaagttcatagtgcattcatttaattttttaaaaatggttttttttttgtcatggcttaattccttgctcccttttcttctcccagaaagtctgaggagatgaaacaactcatttgaaaaaggaagagagagccaggtgtggtggctcacacctgtaatcccagcactttgggaggccgaggggggtggatcacctgaggtcaggagttcaagaccatcctggccaacaggtgaaaccctgtctctactaaaaatacaaaaaattagctgggtgatgtggccggcgcctgtaatcccagctacccaggaggcaaaggcaggagaatcgattgaacccaggatgtggaggttgcagtgagccgagatcgccctactacactcccgccggggcaacaagagcaaaactcagcctcacagaaaaaaaaaaaaaaaaacggaaaaggaagagggatataaagtatgaagaaccagaatggaaaagcagcctgtgagaaccttccttaactccacgttgtttccctgtggattgggaacgatggagttgtagagagaaggggatctgaggggacattttaccactcctctcccaccagggtgtaccacacagatatctgccaggggcatctcacattggttcccactgtgtgctctgagacactcaggctttctcacaccttggctggaattcttttcctttccacctgtgcaggagagacagcccactgagaaggttctgcatgtgtcaggccgacattcttgctgtcatcaaagaccacaggggtcttacctacagggtgatgctagcattttcctgggtactttggattgctaagtcccattagcttttctgcttatcccaagtccccataccctcacctcttccccctgcatccttttgcatttcagcaaaaagcaccatcatctggtcatttaatctgaccagaaatcctgtttcctatccaccaggttcactccatttctttgccttgaatcagtacccgtctctccatttcacagggcaggctgccatcaccttatatgttacaaccccaacaagttccttactggctatcctactttgatctatttactcgacaaatacagagtccctcctatgttccaagaagtattttaagtgctgggaacacagcagtaagaaaataaaaacaagcaaacaaaagaacaccagggaaaatggaatagggagcaaagatcgtatcactaccatgaacagggtgttaagcaaggccaactgacaatatgacagactcgccttttcctaccctctgtaagcttccccctctcccccacattcagccaggatcatcttctcaagatgcaaatcaggtcaaatcaccttccagcttggaaatagccactgacagtttaaatagcagaggcatcaaattagtatttgacaaataaatgtgtaggttttattatcacagtgaatatttgcaatgactcccattttacaaaagaatacagtgacattcaacagatggtaaatagcaaagccagaattcacacctctgactccagagccggaaacagctggtgtggccagccacagcaggaagtgccacagaatggggcactttccttacagttgtccccggaggtgtgcatttcacccacatcatctaataattctcaccaaatgctccctggaaggatgcaaggaatacttaccgaagcctgaaatgaataatttaggtttttacaaatgcctgcccttcacctggaggaagtgtgcacagtactaaggtgcatgggctcggcaggctgactgcctggactcaaatgccagcttagccactccctggcccagtaaccagcctgggcctcagtttctccattaataaaaagaagcaaatacttgtagtaccaagatcacagggctaaggtaaggtctaaggtaagcactcagcaatgtgcctagattgttattttttaaactagtctctgaacaaatgttatttctctgaatccaacagtccacctgtcattgttacatttactagcactgaattgattcaatctcaagaaatgaaaaatgtggatttacttttaaaatatttcactctttactctagaatgacagccctaaaataaaaaactttcctgctgctgccatttaaaaatattattatccataaggtaaattcagagagattgatggtatggtcttgatgtgcctatcatttgggcttactgaggctggagaatgcccatccttgagaatatagaaaaaaaaatagtcaactgccttgggtgacaaagtctcatcacttgccccaacaggtgataacgtgaggatcaccaaacacccatccccaaggcaaggtcccaacactgaaagccaaaggtggctttaaaaggacgggacaataaccaagaaaccagggttagctgtcgaatatctaaaatggtattggcttccatgacatctctctatctttcacccctaactactctacaggttaccagattaatgtttttaaatataaaatttctaaaaagtaatttcagatgactaagatattaccttaaactaggacattttcattctagaaggggaaggggtacttgttatagtagatgaaattatgtttgaacagacagaaatgggctaaggctttttaggaataatttctcacagtttacttatgtaaaaagaggcaaaattctttgtcttttgttttgtttttgtttgtttgtttgtttgttttgctttacaaaacctcaatttgtattctctatctttgtgatttttttttcccctatacctccacacaatgatggaatgaagactgtgagagaaacaaaggtaattcattttataggagatttaatatttacagaaatgccagaagttcatcattttccatcttttctaaaaaagagagagcttcaagagagtttctataggacttatcaagtttcttgattttggttaccaatttaggggactgtgtaaaaaaggctgcctagtgaggtcataggacccaaaccagtcatatcaacaacatgaccttgtgacgttgaaattctttataggagctcataaattatgcctgtaggtaaaacagcctcaacatggtttggccagtgttttgagtacgtctcttaacgtgaacagtttagagatctttcttcttcctttatgttttgtcatctactaatcccacacccaccccatttttctaggttttgtgtattcttcttaataagtctgcacaaatcactataatgtagctgaaatcttaattttcaaattgtgcttcaattaccatctacatgaagccaactgggagacatgcctttgtctcttggagtttgtcaggagttagttctttgcatgtgctggatggaagttgctgccaaagctagagtttccacaaatgccaacaaaacaaacggttgctcatttatgcatccattatattacttaccccctaatatgtgtggtaattctggccttaaggagagcagaggagataagaaagacatttaaaggcataaccgaagatgcatgatagaaagcctcacgaaggaaggaaggacatcatggttcaatactgtggagggctcggaaagggcaaaggatacttccagcttcaggaaagacttcttgcaaaagacatcattagatataggccttgaaggacatttgacccaaagggaatgactgaaagaattacccgaaggcaagataattcagggtacacaaggaaaacctaaaaataggtccagatcagaagtctttgtcttaatcttcctgcttagcctttgagtgttgagacggcaaatatgggtttgacaaattaaccagcaccatcctttgatttctcactaagtcccatttcaaattatttcagaaaacagatgctgttgaactcataaggtttcaaggtttctgccatcacttctctcagttccttcttttagctaacctccatcccttgctgtaattttgagcctgtttcttctttctgcatccatgggcaataggtggttatcatggtccttactatgccactatcttccctctttgtccaactctccaatgccctgcattcctcaacctcaactctcccccacactgaggacctcacatggcaatgcagggtgctctgctcatgccaatgaaaagccagcaagggctgcctcttgaggcttgtgctgtccacatcttctcattcatgctgcccggaagtgcctttgacttttcagcaatgcctctacttggggtcgattctcttgactagatctatacaaagccagctctgcaccatcttcagctcacagtttgtcttttctcctgccccgctgagttcaaataattgttactgataacttctttaacacatcaaggtcataaggaattctaatcctttcctgtaagatgccagctacttctgagtgggttgtgttccaactcggtggttacagggactttgaaattggccatgtgtttaacatattgaacaaagacttagatcttgaaatgtgcatttatcctttcacttattttcttaatttgtgaattgactaccacttatggatcatgcctgtacatctgttttagatgtgggattttttttcaattcgtcatttgaattaaactctacatagtatgtcacacatagcttgcaatatgccagcatacagtagaacaattatcttttcctttgcaaatctgattaaaaatgagccaagtcctgtccttctgtggaatgtgtacatgtaatggggcagaggggtaaggagttcttttgagaaaaccaaagcatggcttaactatatattttagaaaatattatagagctttctacccactgaatctaatgccatggaaattattcaaatgctgacttgatgccaagggccatgcccattgagctcattacagaggaacaaaaaagtctgatctctgggtctccatactagagtcaagcctcacaattaattccatgtgtgtaactgtgtgtgcaggtgtgtacatgaggctcccttgttaccactgctaattatatataattgtatctacagtgttgtgacacttactatgaaccaagcactgtgccaagtactttacataaatggttcatttcaccttcccaataagcctattgtactgggtacgtactattattatccccatttaacagatgaataaactgaggcttggaaaggtaaaactcacataaactcaactccgtcaactccaaagttcaggttcttgactgcattgccattctaaatgtatacatctaagtcagaggcccctggagtattggctccaggttttggccatggctggaatggaggatgagttgagtgagctctacccaaggacaatgatagcatctccctcaaggtggtgagtaatgaaaaaatgtcccctggcctgtgttcaaaaggaaaggtctactcagctagtgccccagcccttagaaaggtcactcccagtacttcacaggaagaactatactactacaagtccttgccctgaaatatatatggctgcattatgaactgtgggacagataggacctagttttaataccagctttcctaattactatctgcacaatcttaggcaaggtaattggtgtccctgagcatcaacttactcatctgtaagaaaagaataaaaatagtatgtgtcggctggggggcgatggctcacacctgtaatcctagcactttgggagccaaggtgggtggatggcttaagcccgggaatttgagaccagcccaggaaatatggtgaaaccctgtctctaccaaaaatacaaaaattagctgggtgtggtggtgcgcgcctgtagtcccagctactagggaagctgaggcaggaggatagcttgagcccagggagttggaagatgtggaaagttgtgatcctgccactgcactccagcctgggtaacagagtgagaccctgcctcaaaaataaaaaagaatggtatttatttattaatacctagtagggttgttatgaaaaatatgttggttaagcccagtatgtgatctccattcagatacagggctagacatggcatctcaattatttcttatatggcaggatttttcactagtaacttttcatatattttacctctttagagcttttagttactaacactccattttattttattttaaatgggaaataggaacaagggatataagaagcattcttctctccagtaaatctacaaagacccaaaacagatccctattgatccatcagaactcaccagagaaaatttaccactccatatctgataatactactcccacaggctgaaaacagcttcaaagtcaaattctccagaagatatcatatctcaagcccaaagaagtggcatcctcctgaaacacatgggctttctaattcctgggacctattagtccctaataagaagaaatccatgtcctggaagccacctcttggatggttagagatttttgatgtgtacccaggccatagtattattgactaagtagccagtagcaaatttatcctcacaatcttttcttaagtaatccacataaaatgacccagtggttccagaatcttccaaattagacatactaaaagggagaggagatttttaactaatccctcacagaaccagttaaactcattcaccttaattactgtttaggccaagtgttgttatcacctctcttctctcatctgaaagctaaggaatatgtggcagggcttgggccagttccaattgggatgtagatctacatgtctgacttaaaacatggcccagaatctcccctgataatctcagagttctttaaacactggacagctggttgcattccttgaccacagcaggagccactctgcaaagggtatctcgagtcctggccatgtgctaggaaagggcctatgaactctcccctgtctctccccaagagaatgatcatcagctacaatgggaggacaacaggcaattcaaaaccaaaaccacagcataaaaagaccttgatctttttgtcctgtgaatcttcccttgagaattcagccccattcctcaattctcacctggatacactgagtcaagcatataattcggatgatatagaggcagcaatggcctaggagagggtccctttgggtactgcaacaattctgcagctggttggtcagctgacggtctttgaacacaccctacctctccccaaggtcttggtttcccagatgtcaacataaacaggctggaggtgatggccatcgaaggtcagctctgttcagttctggtggcctacagttctatttttatttattttttaaaataagcttatttattgagggataacatgcatacagaacatttcacacatcataaacggatagctccatgaattttcacaaagtgctcatacatgtgtaaccagtgcccttctccaaaactagaacataaccagcacccaaagccttcttgtgtagcttcccagtcacctcccaaaaggggtaaccagtcacgagttctctaacaccacagactagtttttccaattcagactttatgggatcaaatgtcctctcctttattgtttctttctctctcagcatgttagtgagattcatctttgtcgtcgtgttacaatagttcatgctcattgttctagagcatttcactgcctgaatataccagcctaaggcttaatatttgcagatgtcccccgccaattttatcctataatgcatgatccactgtgactgtcctgcaaaaaggcagaaaagcagaaccccctaaaagagagactttctttactgcttcctagggccatggatgccgtgttttttccaagtccatagggaagctgagagtcttctaagtggccagagatgctgaaagcaaagtatcaacaccatcagccttgtttaagcagcacctttctgtgcttgctactactccatgagatttacacagataagatcccaagtctcttagcaattttcaagataagatcccaagtctcttagcaaatttcaagctaaaaagacaacactgatgcatagagagattaccgatgcagacaagaaacccaatacataatctaatttaaagaaaccattaagtgcaaatgaaagaaaatacttcatgtgcaaaaggaagaataatggcattttgtggggttatgtcaggtacaattgctatcatttcccccaaacaattggtctgagaagaagtcacatggtatgctggaagagaaaggcactacagaaagaaacagaaactttaaatgaactttcctatttaagcaaacatagagggtaataagcctactggtgatacaaaaaggcagaagagttccagagccatcatctacatcccttgacaaggccaggggactttttggcatcaatgtgatgtgatttggcagccagcattgacaccgttgggaaatgtcagcctgaaaagaggctgttctattggacagatgtaaggccacgacttagcctcacaggcctggattactgcagcatactcttaactgggcttcctgtctccaactgtcagtccttccctccattctttgaactgaagtctaaaggctctcccccaaacatgaacctgatcctgatacactctcacttgaaatcttttcatgattctttattccctgcaggataaagtccaacttctttgtagcttttggggctttggggagctgacctctgattgctttaccttgctcatctctcaacacgctccagccatatggaacttcttatagttccttctgcctagagcacctccctcatggccttcattgggctacttctgcttccttgcaggtgttagggagctgccagtttctctggaagcgcttccccgagggcccctctattctcctgtagccccccacaatacagtaatcatagttaagatctcattccctgctttagcagccctggccagtgcctcaccctcatcccgtcagcactcaatagcacagaacttgtcaacagagtcctaccgttgacaccagcaattctacttgtgggcttcttcttggcatgccctgcacatacaggccaggagcaccagaagttaatgctcctaagagcatccctcagataacagcggaaggaaaatggagggtgaataacaaccctactatcccccacctccagataagctacttgtattcaaatccttgtctgaaggccaacttctggggaaacccaacccagacaatggcccatcccctagccagactgtgaattcagtgaagcttgggactaatgtcttttcatttatcagtggacagcagccatgcctaccgtatgtctggcacatagtacataaatgtttactgaatgaatggtaaacattcaaggaacccttgtttcattcctggttttcgactcaaaggcaatacagagctcagcaaagagcttcggctctggagtcaaaagaccaagttcacttcaaaaggtggaatcctccattcctgatgggtgtgagtttgggcaggggtgggtaacccacctgggcctcagcttcctcttcttgtcaaccagggtcatcatgagactcaaggagaactgtttaaaattgcagggagttacacaaattaaatagtgtttattttaggcattcatgtaattctttgtgactaaatatggggaaagagattttgttctagataacacaagcacttgtggtgggaagaggaagtaaatgaaaattggggctgggtaaacagttaattccacttggagagcctttagaggcagagatctctgttttgataaagatcatttaaattccaaaaaagaaaacagaatggaaatgagaaagtaagtttttaaaagtccagaaataattgctaactataaacagacataaaagataggtacatatctctatgtatgtggagatatgtatgtgtgtatatataagtatatatatataaaacagcagacatgtaatgaactatattaaatatgaaaatcttactatgtttttccactttgtttttgtcctttaacagcttcagaattctaaaactcaaacacatgtatgctgagaaatgtctgagatgtttttaggtcaagctaaaatcaaatgtcatctcataatcttataatcttcataaaactgcttttattttcaagacatgcaaaaatccatattaacccatcaggcacaattttgaatataggactcgaatgaaaaattagagtgtagtcaaaaacagtgaaattcttatttgtggtcaatactgaatgaattaaatgtcttttgacatctttttaatttaaggaccagctttaagaacaaaaattcagagatacaaggaatccagattcatttttctgccctttatttaactgttttgtattctagtggggaaaaaacatggaaaaatctgatccaccttcctattgattagcactctgcaagagtaaggagtatgtgaacatttttactccagagttctcaaagttaatctttcaaggctgggctttctctccagaccctcacccacgactgtgtatcttatgtattcatgcacatggaggacataaaatacatgtcaaacaaaataaagcaagttattaagtacaacaaacccctaaatcttggtggaagtcaacagataaacagactataacagactataatagtctaagtacacaatgcataattcatggctaaaccaaggctaggcttgtgcaatatttcaccagctcccctttgcaatctttgaggttaagactgggtaaattgcactgactgctaactcagcaaaactgaaaaattagaaaagaaacccctaacctttccaataatgggaacaggcaagaaggcagagggtggagaaaggtattgtttagctctcgaagctaggcatttaaaagtcactgtgtgcctagctctcaaagctaggcatttaaaagccattatcttattaatatataattttattgttgacaaatgtttatttttctgctaaaattaagagagcagatcacttcccttcttacacctaatcaccagcccctgtgctcagttcacaataggccttcaataaacatttgtttaaagaacttccttttgatttccatttgttgtctatggaatgtagcaatgaaatgtgaaggtgaatatgcaatgaccaacaatagtaatggaaaggtgaataaaattaagcacctcaatgcaatctggatcccggacaacttttccatttattatttcccaaaatgtagaacaaatgaatgtgcatgaatttcccaaagctaagaagttgaaaccaagtccttggcagcacttcaatagccacaaatgaggctctattccattaaggaccaccatgtcttccagggaatagagagctggtggattctgggtgtagagtacagtgtcatttttagcaactaagaaatgagagagggaagacaaatgtcaagtcagcaccagcagaaattattgtgtttcctgacaacgggtgaaccatgcctggtgatgctataaccctgagccctggggagtatatagattggtccaaatagcaatatttgtgctaagataactgtggatgcaatttatttacttattttattttattttattttgagacagggtcttcctctgtcatctaggctggagtgcagcgcaatctctgctcactgcaaactccgcctcccaggtttaagggattctcctgccttagcttcctgatgtagatgcaatttaattcgttcaaggtactctgcaaatatttttaataatacaaattgaaagaatgctataaacacaaaaaggtgagaactcctggtttagccttctaagcaaatagatttaaccagtcattaacatccccttttgaatgtgttgaggttgatggttatttgctgatcaaaaaagccaggtgaacattctaattacagaatgtctgtgacttatagtcactgcaggactgtttttgcctaagagtaagcagaaaagatactggttctgcaaagtttttattcagtgctatagggaaggtttctttcactgtttaaagtttagaggggcagtgggagacttaaaaaagagttgttatgattatttcacaactcatgttattttgacatattgatgatataaatataatagcagattgcattgttaataagaaaattaaaattaaaaacaaaagagcctagataaagcagaaataatttacactgaatctgttaaaagggataacacttcacttcctatgaaaaatcgtattatttagggcccccgtctacacctaatcaagttacttaaaacctcagtacatcactaatgaacaaagagagacagagagcaatagaaaaacttgaatggtagctcgaggctttcatgaaatttaaaagatgatggtgagtggaaattttaaaaatttggatgtgttcaagtaaaatccctgtgtaattgcctagatatagaaatagtgccagatctctgcaacataggcacacagattagaatttctttctggacctttaaaataagcattaaaagcaaaaccatgtacctttcacaatatggaaataaaaactagtactctcacaaaatgtcccttctctgagttgcactttaatgttatggcaccctcttttattgggagtcattgtaggagacagtgatatgaaaaccacatctgcatttgctggaaagggctgtcaaaggaattatccattatctatagaaaatcacacataagaaactccttttgctatctggtgccaggaaaatctttatctctagaaactaatctgtttcctcctttctaataacaagaatgatacaacttttatcctgtttccctttttgctctggctgccagggagttcagggccaaacttgatgatcagtcatagtaattataatggactttgtggctagaggaattatttcctcaggttttcatggcttttattttccatttttagttgtattaatcatgttttatgtgtccatgtgtgcacacatgtgaagacttggttttaattgtaacttacttcaagtcctttttggaaaacaatgaattatgtttatctcataaaagtaaaaaatacaagagatgtatgtcaaaatatgctttttcttggtacaaatagctttcatacctgtgtgaaagcatacgcattttgtctttctctttggggataactacttctaaacaagttatatgttagtcaacattatacccagacaagctttcttctgcttatggatcatttctttgacaaaataatacatccttatttatagttgataccttccagaaaattaacaccataattttgcaaaactttgttaaactcacagttatcatgaggtccttaaagttggttctgatggtttggctgaattcacagaatcactgtacaggattcatttacattacatttaccaaatgtttgaaatggaccatcatgtcattttcactttgcttcaatgttttcttttttcttaggtaatacataggaaataaatggttgatttgcttcaaatggtctattttccttccctgagcctgttacattagccagcttacatttaaacatattttagtcatatagattttccactgactaataagcaaaacacagctttttttaaatcctaaaaaaaagtacattaacgttctttcaaattattgttttaaaataatgttccacattaaattcccaagcttgggacaaaccggaaagatcccctgagtttttaaaccatattcatttccctgagcacaggggctctgcatcctggatggtacaatgccttcagtgcccctgtcagttggaatttaggaagtcatttctctttaatggttgccagacctcctggataagctggggcaccttgctttgccccagatctccattgagaatggaaccttcctacttactttcccttcaccgtcataagaacactgggatcctgctgtcataaaaccgttttgacccctgaatcataaagctgtacattaacagtgggattgtttgcaattaggtaactgatccttttccccgtttaacttgagtcagctcatttgatactaacatagtgcttctgtaactccacctctccacccgctgcctttcactcccgacaggtctccaagaatagctgggtggctttgttcttcaactctgtacgtaaccaagaaaccaaaaccatagagggactggatatcagctcagggcctagaatcagacaaagccccctcagattgaatctggggactgccacttcctagctgcatgaccttggataagtgacttcattctgtgaaacctgagtctcctcatctgtaaaatgtggacaccaataacagtacctgccttatagggttgcttcatcattcagcaaataattacccagagtacctactattggccaggaactgtgccagggaccagaatacagtcagagcacacagggttctacctcatggagctctcattatagttgaggagtcacaaactaagcaaacaaatgaaaaatgcatagttacatattttgagaagggctccaagtgagacagaattctttggtgagcaacagtgagaagttgtggtggttgaggggggagggtagaaagaaatcaaggcaggcctcttaggcaagaagcatttaaattataccggcaaggctatagcagaggaagccagacacaggacacatggaagggaatttcaggaaggcggaacagcacgtgcaaaaggttcgaagcaggcaaggcctggctttgtttgagaagaaaagtgaactattgggccttcggtggactgcatgagaagcagaaatctcaaaagtgaggttggtgaagctcatcagcgatccaagacacaaaaagacttgatccagagtttagaacagatcagaagtcgaggaattacagaactgcagtccatgggcccattgcctgtttctttttctttctttttttagatggagtctcactctttcgcccaggctggagtgcagcagtgtgatcttggctcactgcaacctctgccccctgggttcaagcgattctcctgcctcagcctcccaagtagctaggattataggcttgtgtcactacgcccagctaacttttgtatttttagtagagatggggtttcaccatgttggccaggctggtcttgactcctgacctcaagtgatcttcctgcctcggcctcccgaagtgctgggattacaggcatgagccactgggcccagccccactgcctgtttctatgataaaaattgtactggaacacagccacacccatttgtttataaattgtctctggctgagttcacactactcgcaagcctaatatatttactatctggccttttaagaaaaagcttgtcaactccgaaacagtaaacttcaataactgtttaaataaaacaacaaccaaaaggggaaacaaaaaggccattttttttcccacatatgtgagagcaagtaacaggctttaattcaaacacctttgagaaatggtgtaaatgaaaatcctgaaaacatctagaatgtaagactattggaaaattaagatgaacaaacttaaaatattttaagacttttcagaaattatttctattcatagtgtgtacacattaagcatatgaaataagacacttccagcattgtgtctgactagatgctaggaaaggccctctcaaaacattttttattgcattgctgggctcataggaaataggaaaaccctcaaatgaactaaaacaaacaaataaacaaaattccaaaactgagctgaaacaagaatggtatgctgaaagcccacataaatagcagaggttgctctgagcacaaacaccatggtcatttgtacaaccgagagactcagccagtggcaagttgaaagggcttaacatgaaagccctgataaaccaggattcttaaaggagctaggtgatcctagattgatagcagctccctgctcccagaagaagcaaaagtaaattttctctgcagaaaaatatctccatttcagtcacttgcggttcccactaagatttgtcaaatataaattcccccagatcaccaagcatataaggaaaccagtcaccagtgagggaaagatagtggaacagacgagaataagtgcaaatttagatatacatccccaatggctttggatattagaattattaattaactacagaatataaaatggctatgttcaaacatgcatattatgcatatatatattacatacatatacataataagtgtgtattgcatattgaaattttgctaagagagtagattttaggtgctctttctacaaaaaggattagaaataaaataattaaatgaaaaatgagcacgcaacaacagactatcaaaagttactagaaagatttgaagaatccaaattaaactttggggaatgaaaaaatataattgttaacctaaaataataaatgggtttagccacatagtagacacaggtgaagagagaatgagtgaactagaagataaaactagagaaactagccagaatgcagctcacagagatcaggggagggaaaatgtgaataggacatcaagcaatatggaggacagaaaaggaaagtctagcacattcataattagagcccataaagagagactgaagacacagaaagaaggtaatagatatttgcaaagataatggctaataattaaacagaactggtgaaagatataaatttatacatgtgtgaagcaggataaaataaaattaataccaatacattgcagtaagaccacagagcattaaagaaaaaagatcttagaaataatcacagaggggctgggtgcagtggctcatgcctgtaatcccagcacccagcactttcggaggccgaggcgggcagatcacgaggtcaggagatcgagaccatcctggctaacatggtgaaaccccgtctctactaaaaatacaaaaaattagccaggcgtggtggcacgtgcctgtagtcccagctactcgggcagctgaggcaggataatcacttgaacttgggaggcggaggttgcagtgagccaagaccatgccactgcactatagtatgggtgacagagcaagacttcgtttcaaaaaaaaaaaaaaagaaagaaagaatcacagaggaaagatagccacttaaaattagcccaacagccaagttttccacagcaacagtggaagccagacattagtggaataacatgttactgagagaaaataactatcagccccaaattgggtgaatcaaggatgagggtaaaagaaggacattttcagagaaacgaaaattgaaatggtttatcaccaatagacctacactaaaagaatttgtaaacgcataaagaattataagccaagaagaaagaaggtatggtaaaccaagaacattatttttaaaaaataattttataaatgctttagaattaactatacatttttaaaaataatgtccaatttattgctaaaaaaataaataataaagtactagacaagaagcgcatgtacgtaagagggtggtacacagagttaatgtgtgttctcatctctatataatatggaagggggattcatcggtcacagtagcagggctagtaggggccatgtacagctcagtcacacagctttttactcaccaaagctgatccagcaaccaccatggctcaatgtataaagtgctactgcaaaggccaatgctgagttcctgtgtggactaactggctacctagtgacacattgatgacacttgacttctctgactttgaagagggcagtaccttgatttacataggatagaaacattgtgtgtgtagattttccttcttttccttcggtattcttccaggaccacaattcttatatatatatatatgccttatatatatatatgcatatatatatatgccttatatatatgcatatatatatgccttatatatatatgcatatatatatatatatatatatatgccttatctatcacacggcatcctacacaacatcacctccaatcatgggacacattttaccacatgcagtgcatcaaaggatccactccacagaagttctggtttagtaacagctgagtgacaacacacaaagaggttaggatactttcctataggaatggaggatgtgccttaaatcagaggccactgtatggtgccatctctcccatagtaaggatgcatgactggaaaaactgaggaggatgtgggagtggcccctctcacgaaaacacctaatatcttgttggaataatgtttgcttccaccagagaacattatcatgatgtgatgaattagaaaccgagactgtcctttggccattttgggctcttcgttccattgacccaacagtcagagtaggggtcaccattactgctatataatagggataaggaaggcaatatgcataacccagggattcactggggtgcccttaaacaaaagtcctggtcagtgaaaacagtggtaatccaatcaagttaaagccatcaaggaccgagatgacttccattattgaaacaagatggaagatggaaatgtgattactagtgagagcttgtagtcagttatagagacaggggctatagcagctttctttctttctctttcttactcttttttctctttctctctttctttctttgtttcgtggagtcttgctctgttgcccaggctggagtgcaatggcgtgatgtcggctcactgcaacctccgcctcctgggttcaagcaattctcctgcctcagcctcctaccgagtagctgggattacaggcacgtgctaccacgcccggctaatttttgtatttttagtagaaatggggtttcaccttgttggtcaggctggtctcgaactcctgacctcatgatccacctgcctcggcctaccaaagtgctgggattacaggtgtgagccaccgcgcctagccggaagttatgttttaagtcaccactaagtgacttttttctccccttctgcccaacttctaccatataaaaaaagacaatgctcatgatagctcgtgttttagatgtatggccaaactgacattatctcacaatgacacaagacctaaggtgactccacacctccctcgtgttggaagcaccaacttttcatcttgatgaaaaacaagagtagaggccaagaggcaaatgagtgaacggcactagatattgtccatttgcccttctagatccatctccacttttctctccttgctttcttccccacagggtgacatatacaaatggcagcagagagctctgcaccctcaggcttccagcagagttgagctaatagcaggagatagatgtaggaaggaaagtggggtcagcacatttatttccctggttccctcccagtaagttcacctcagactggctgtgtccctcaaaagagggttactatccttcctaatgcagctctaggggactctctcttcttcaagggtctgaaaacctctccttcttttgtccttttgggcctagaagcagtgacatttctgctgctgtagcactaggttcttgaacaacccataacattcccctatattgtgcccacacctttggaattaatccctttgtacaaaattgcttcttgaattatctcaagttgaaatatctgtttctattgggacctgactgacccattcactgtgattacatattacttaatacaatgtctatgaaccaacacccatacaaagagattttcttaagacgcccataaactgagagacctgggtaattcccggacctgggtaaagtcccaggaaattccctgtggactcaaaaccggttaactgtttggaagcacctgaagggctcagaaaaactgtttataagaatattttctggtaaccagggagaaagaggtccaagagggatgtgaaaagtcaggtgcatgcttcttctggttgtaactcttgaacaatttctatggaaaaccaagagagagccaaaggtttgtctaaaaaccaggttactgagttaagagaaatattaatccagcttagtgttaccttcttgcaggaccaatttccttaaaacaatttgaatcatttgaatgggtatgaatttataatcaaatgaccaactgaccagatacccagagggaatcctaatatttctggaagaaagaggttctcgaagtgagcacaggagcatcacctggaagtaggactggctataatttggcagggcccagggcaaaatgaaaatgtgggacccttgttaagaaattattaagaattccaagacggtgatagcagaaccattaaaccaagtacaaggctcttctaagtgcagggccctgtgtgaccacacaagtagcccacccatgaagcctgccctgcctggagggtttgttacaacacagactgggagccctgctcccagaacttccgatccagtgggtctggggcaaggcccaaaaatttacattcctaacaatttcctgggtgctactgatgctgctgtttcagggaccacactctgagaactaccaccctagataatatagaatacagggaaaaagaaaacctcagaataaaatgaacacatgaccaatgtatttagagcttaagctgaccaatctatatggattttgtactgaatatcacagtgtatatctacaattcataaaaaggtaaatgtactcaattacaaatttatagatacaaatttaatatcctgaacgttattaactgcctgtatcacatttaattattccttttcccaacaaatgctttttgtctactttatgccagggtactgtgcttgctcacgcattatgtattgaataggtcataaataaatgaggatattatttagaatagttatcttgagtataggggacggggaggtatgaagttcagatagggagaacacccagatagggaaattaaaatgtgggaatgctatgtcattttttataagcacaaacctattagaagcctattaagaaaatataccttgacaaatattttgattttgataaaattgatacataaaatagaacaagcatcatatctcagtgctttttaaatggtagacaactcatttcaagtaaggaagaaatatttggttttcatggttacctacaaaagtttattgagaattttaaactcctgtcctatattgaaatactcagtatataaacacacagacaaaatcttcagaaggtttcaaatactccacttggaataacccaagttagttgttaaggaaatcagcaagtttagggggaattttttttttctgaaggattaacagaaagttagatatccttctatgaagatgacactaccccactgtcacttacaaggtcttacaaagacactgactgttttcacaaacatctccagcatcacagcctgcaagagtccatgccagcttcagtgttctggtttctcttcctgaatatacggtgtagttagctattgaccgtatatcattacgatttcaaagaatgaaaagttcgctcatgtggaatgtaggtattcttgacctctgaactccattgttctgaagctggggaaaaatatgagtatggtggtgatactaaacaaatctgataaggtcatgcttggcttcaaaggaagaccagtaaccaagtgcacaatagcctgcaatttccagtatattcttctctctaagccttgagtgttgataattaacttcctactattctaaactgaatttattgctttttcaattgcaattttagtaaaattacataattaaaattttaaaacttattatatgatattcaaaaaattaaataagtgatatttttctcccatggcctccctacctcacacttaaacataacgatgaaaatttatgtaccatattacaagggtttactgggaagaacattaatgaagaataccaagaaaactttatgctagacttctaaaacataaaaataaacacaggaactccaatttccaataaaaatgctcaaatcaagggcatttcaactgatgaatatttactatgagtttctggtaattttttttttttgtaaaggcatcatttttttttcaagcaaagatcaaagaatattttgtatctggtcccctgttgatttatatcagtttaactgccaatatttcttaattcagaatgaaattgcacagagctcaatttataaatatttatgtataaagttaacaactgtgaactgtagtggtgtgtcaaactgtaaacacagtcatggaatattggttcattttgagaacagatgttatgctatctccatcatgggactgattgcaggagaaacaagtcatgatttagtctcttgctttttagcaactttcaaaacaacaggtaaatctagggagagcaaaacctgacacttcagtccccactttccatgcctgccatagtgacagacatcactaatttatcctagaacttcctcagagctcagattacccttggtataattttcaacatgtgctccggcagtcactgtctattgactggaagttatacaagattcaagctattttctctgtatttaattctcgtatcttgcagtggttctcaaaatttttttatgtgtagtatattttcaaatattagaaagtctgtagcattctcaaagggattaagagattgaaaacaattataaataaatttcaccaacaataataatcgaatccctctcacatcctcttggtctagtaaagtggccacaattatctggttcattttgtatccaagttaccctcaaagggtaactttacagcttggctacaggcctgcatttactcacagagtaaagctcccatgtacccattaaacacattcctttgggtcctcctggtggtctgcttaggagagtaaactctactgttaagagaatggggtgagatgcgtcggtttgccttagaaagaacattttggccaatgagtgttagcctaaccccagagacaggatgattaggagtctactggttgtttgctgtgaaaaacaactaggtatccctgttttatttgcattatttcctttaatcctctcagcactgctgtgagagaactgaggttcagcgaagtgagttccttgccttgtgaccctaagaagaactgacagagccaggactctaatcaggagatatggctgacttcaaagccagtgtgctaagcctgtctgtaactccgccctccggtgactaacagaatccagggaccttccatagcaggaatggatcttaaaaaccaacagccataccccaaaatgaaatagccaccatcattcttttcactgcttcagtccgagttggttttattgagggcagggaatccacttcctgcttggaccaggtacctgaaagcaactgttcttctgcttgcttcaggaagtctttctgaatcactggtcttccacttgaagtgtggcaactcataggagataaagcagatgagagggctttgtaaacattaaaagccacagtgccacacaatatgaattagtgtcagaattacttaaatttagccctccaccttcaaacaggagctatatttttattctcactttataggtgaagcaatggaggaaggaagacagggaccctactaacctttattgagtacttactgccaatgctcctctagacacgacatacatgagatcatttaattctcacaacaggcaccaagtgtatgtttttaattccttctgtttaatttttattaccttgtcacctactatatgttttccttatttaatttacttatcatctgtgccctccccatcccattagactcttccttaagtgattcagattttggtctgtttcatttactgctctatctctaatagtgcctgacatagagcagatgttcaataaatattagttgagtaactaaatggaggctcagagagattcagtaccttccctgaggtcacacacttggaactgagccctgtgtcatctgtatccaatcaccatgtgaacactcccagctctgaacctggggttgctcgaatgattgacgagtcccaccagcaagcagaagactgaggacagtacagccacatttggatatcacttggcattgcatttcacaggaaaaaattgtgacatttgtcacaggtagggaggggtgctaccagatgtgctctgaaattattgcttattcacaacaacaacaaagatagaagtttagcccagagatagcagacagattctagatttggaaaaccctaaaataaatggtcctgatcggattacacacccagaaacccagctcacaattcttccttgatactttcctcctagtctttggcccctgtctggttcagatgcctgtaattaaactcaacagaaactgaccaagggcctactcacggccactttttgtcacccacaggtgggaactggggaaaatgttctgaaatattgtctactatgaggagaaaggcaatgagacactaaagttcatatgaagcattacaaaaatgatagagcatacaatagagtgctgaggaaggaaagcctgttatctaaaagcttaaagaagatatgaggggctgggtatagtggttcaataatcccagcactttgggatgccaaggtgcgcagatcaattgaggtcaggagttcgacaccagcctgaccaacatggtgaaaccctgtctctactaaaaacacaaaaattagctgggcatggtggcatgtgcctgtaatcccagctactcaggaggctgaagcagaagaattgcttgaacccaggaggcagaggttgcagtgagctgagatcatgccactgcactccagtctgggagcaaaactccttctcaaaaaaaaaaaaagcaaagaagaaaaaagaaggaagaagaagaaagaagaagaagaaatgagagaggagggagcttgtgatctgggctaggaagagagtcactgtccaaaggaaggaagaatcacaaggtcaccaccaagctgaagcagaggaatcatagattccagaggtctaagcaaaactcagaagcaatagaattgagccccgggattctcacccaggggtgattttgctacacaggtgacatttggcaatgtctggagacatttttcacaactagggaggggtgctactggcatccaatgggcagaggccagggatgctactaagcatcctacaagacaaaggacagaccctacaacaaagaattgtccagcccaaaatgccaatagtggcaaggctgagaaagcttgactcgaaaatcataagctttgaaggccaacacacctgagttggggtcccagctctacccctaagtagccaactgacgttgggcaaatgacttatcctcactcagcttcagtgtgtttatctgttaaatggcaaatgctagtggtaactactccacaatgatcactccttcattcagcaggtatgcctaaggggtctcctaagtgtggagctaaacgtggaatttgggcataaaagcaatcaatgatactaaagaggtagaggtgctactgaagagatacatgatggctaaagaagctccaagaaggatcatctaccctacacaagagagatcaaagacttcctggaagaagtagcatttaattcaacatgtgaaggacggtgaaggatgactcagataaagaagagtggattaaatgagataacaaacgatactcatcatgagatgtatacattgcaccaggcactagagtaaaagtttctcttcttcctaggtacttggctccttgtttagacattttctaaacttcattacagttgatatggctgtgagactatgttcgtgccaatataattgagaagtgatgtgttgatttctgggcctgggattttaagtcattgatttcccaatgacttctttttgttccttcctgaatgcaaaatagggaagtggcccagacccaacttcaaccatgctagggcaggggtaagcagagttcttctgtaaggggttatatagtaaatattttcagctttgtgggtcatatgaacactgttgcaattactcagctctgctactgtagcacaaaagtatctacagtatacaagtgggtgtggctgagttccaataaaactttatttgtaaaaataaaattaaaggactggatttggccagccgcagttttctaatccatctgctcgagatggaggagcaataagatggaaggaacctggatttatgatggataacgtggtctagaacttccttatcaacctagactccttcctttggaattgttaggagagaaagaagtaaatatatgctttaagccttataacttagccttgccttaactaacacatgggcttttcaggcttctttgggcttatttagactgtccttggaacccaataattatgtacatataatagagtcttccgctaaaatgacctctgagcatgaggcttttggaagtaaggctgccttcaggctggagggagctcatgctttagcatcaagggttgagggttaaattctcagcactcattccccatccagctgagtgaagtaaattggagacatcgtcatcatttcaaaattcaaggtttatagaaaacctaataaatcatctaagtctggcttcctgacacctactggtgtcctcctggaaactcccctctaagtaagtggatggtgagtgcaccaaatgagatgaaagagcagacaaactctgggtgcttgccggcaggtcatgctggctcaatggggcctagtgacctaaaataagatgaaagtagaatttcttgtgggcctctggaccaaactcaatgacggcgttaattatttctggtttgcctatggctgtttttgttgggaaagtaggaatgcaaaagtatcccaggcagatctttttccaaaagagtttgaaacaaagtgatcacaattctttttacagtcacaaaccatttacatctgtaactattttaggtaaccccaccttcaacagaaagtaatcattgccaattctaaatctctagactatgacaaaagagagctaaaccagtcagaggcactgggagaggagggagggttggcagtgccaagatgtttccattagagggaacttaaaaagcatccagtttagtttgattctcccatttcacagatgaaaaaattttgactcagagagggtaaatgttcaaggtcaaaaaacaaaataatatattattataccataattttatatatatatatatatatatatatatatatatatatatataacgtataactaaacatatatatatatatatataattgtgagagaatatgactctactagtccttttccccttttgttttctatattgaaaagatccagaggtaaatgtggatctcaactttttaatcaatttttgtgaccaaatcacaaactcttataaaacttggagttaataaaacctccagaatattgatttatttattaacttcacttagttgtctactaagaaaaatggtatgaacaagtaagatatttatacctggtctggtcaaatagcagctatgtcccccagtgcagtctttttaaaaaaatcctacagaattctatggctttcagaaataagatggaaaagaaaggaagtactagttacatttagagtcagatgtaaagatgcatcataaacaaaattcacttttctgtttcaaatatccctgtaccttttaaaattgatatataatatatgtacagtgttttggaatacatgtggtgttttgtggcatgcatagaatgtgtaacgatccagtcacagcatttagggtatctatcacctgggaatttatcatttgaggacatcagtctaggcaaggattatatggctagtatctgaaaaacacaggcaacaaaaacaaaagtagacaaatgggactacattaaactaaaaagcttatgcatagcaaaggaaacaatcaacagagcgaagagacaacctgttgaatgattatctcaataataatactatctcagtagtatttgcaaactattcatctgacaagggactgatatccagagcatataaggaactcaaacaactcaatagcataaaaattttaacttgattacctccgtaaaacaataagaaataaaataaaataataaccccattaaaaagtggacaaagaacataaaaggatattccccagcacttttgcagggccatttgtctatcaacacaaccaaagtatcaaagtccccactgggcttccctacaagctggttggcatccgtgcctcaaatcacagaggtttgtggtaagaaattagctggaacaactgctggccacatttttgatcccccaaactgcagggaaaatgcatgtatcaagtgttttcaacacattttcagatacaccaaatatgttacaataaagagcatctcaggtagaggaaaacagttttgttagttcttgagtctagtgtcaaaggggcagggaaggcttacacatgaaaagcaaagatgtacttcacattaaataatccacgatgacaagattttaaggagataagtccttttcttcacaagatatgtttaactcactggcatgtctacaaatcatcaggcaactactgtacattttaaaaatccatcttagtcctccattcatgaaaacattttcatattctgacatgtgcaaatatccctgctccttttttttcttttttggttacacacagaaatcatatcatagaagaaaatccaaaatataaagataaggaaaaataaaaacaacaaactataatgtcatcaacccaaaataaataattttcagacactggtaaatatccctccaaatatttctatctttttctctcatgtcttattcccctcttctctcctccaagtatataacacacagacatacacatcctaaaatgaatgcacactctacatagtaacctgagtttttttcactcagtgatatatgtagaaggtctctctctccctctttttttttttgtttgagacggagttttggtcttgttgcccagccgaaatgcaatggcatgatctcagctcactgcaacctccgcctcccaggttcaagcgattttcctgcttcagcctcccaagtagctgggatcacaggcatgttccaccacactgaaagttttgaactttcagtagagacagggtttcaccatgttggccaggctggtctcaaactcctgaccttaggtgatccacctgccttggcctccctaagtggtgagattacaggcgtgagccaccacacttggcctagaatatctcttaatgaaaataaatgcatatctatatgataccttaatgggtatattgttgttgaacaaataagagatgtctctccttccctctagtatcataaatgattctttaatagatgtggatatccatgtacctagatctttatgtatctgtctagtagtttccacaggctaaattcataaaagaatagtcacaccaaagaatataaatattttaacgtttcagaaacctacaattcccatgttaggaggagtgctgttcagagctgtcagaaagaacttggtgatacggaaaggttctatatctgcactatctgatacaggagccactatccacatgtggctaacatgcatttaaaatgccattaggattaacttttaatttgctttaattttaatttaaatagcaatacatggctaggggccaccatattaacatcacagattctagatcaagtcagtattacttgaacttttaagagtaaatgtgccatatcaagcatgccttttcttaattaatcccaaacgcaaccttgacattaaagaacatcatctttcctatcaaagagcttttaggtactctctctctcaagtggtcttcacagtaccttctgagaaaacaagggcaggcgttatttttttccatttcatacatgatgaaaactggagatcacagaggcaaagtaattcagagtaagttaaaagaggcaaatggcacacagtccatgttttcagctctttgtccaatgttctttgcttataaaattagtctacattacctgagccttacacagatggagttctgccaaaactgagctcaatttcttgccacctagcctttgcctatgtggttcccactgccagggatactggtcttgttcctactcctttgcctacctacctgctctttatcttccagaaatcagcttagatatcaccttgcttcctccagcaacctttctctgactatgcacccccaaggcctgtgttacgtatcccattctcaaaattctgtagcattctattctcaccctaggcataatacatttcttccttcctcacaattgcctatttgtcttttttaaatttaatgttattttattttaagttccaggatacatacacaggatgtgaagctttgttacataggtaaacgttacataggccatggtggtttgctgcaactatcagcccatcacctaggtattcagctccacatgcatcagctgctcatcctgatgctctccttcccctgcccaccccacaggccccagtgtatgttgctcccttccctgtgtccatgtgttctcattgttcagcacccacttataagtgagaacatgtggtgtttggttttctgtttctgagttagtttgctgaggataataattgcctatttctttatctgaaatcggaagctgtgctaaagcaggggccatgccattcttgtttacttcaagaccttcagcagctagcaaggtaccttctcccatagaggggacctcgacaaccacttgctgaagcagtaaataaaagtataatagaagaagggacccccacagcatgtttgttatcaaagagcaagtattctgaggttggaaaaataacttcaaataatccattaatgtgatactcaaaagaatacataatcaattataaatataaactaatccatcacgcaaatacttgttgtgtatccatgatgttccagacattggattccagattccaaagatacaatagagaataagagagtcacaattactgctataatctgatgaaacaggcaatccacagggcacccaactacaagtgggaggaggtatgatgaatgagcttgagagggcaatcaaagagaacaggagggaggatctacttaaaagcgggggaagggagcattccaagcacagagagtttgactattttattaaaagcttggtaataataaacacaaaacccagggtcatgggtgtatctcagggcaaggcacacaataggagagggggaaaccccacacagacataatgttataattaatctgctgactcttggtgtgatggtcagtttgtgtttgtgtgtacgtgtgtgcatgcatgtgtgtgcatgtgcacgtgtcttgcatgctgcctggaccaatgatgacagtatggcatgaatcaagtatcatggtgaaattaactccataacctaaggtccatttgaaagacgaatgagtgccaggcactgtgttaagcactgtacactttcttatttcaattctcataaaagtccaatgagaaaatactgtcattatccctattttgcctattaagaaaccgaagcacagaaaaaccaagtaccttgctaatgtcctatggaaagcaaatgttaggagttgtaccaaggcagcttgactccagagccacagtcttctaaaccactgctatacaaaccttctcaggctatactagttcggttacctatgcgtccaatacagtatagctaggttcctcctagccacactgggctatttaaatttgaattaattaaaattgaataaaatttaaaattcagttgcaccagccatattgcaagcactcagaggccacgtggagcaagtggttaccctcctggtgagtgcagatggagaactcatcaccacagaaagttctactggacagccctggcctacatgattgcagaatcaagaacatagctcaggtcagctcattccttggttctgtgctcgttcccttactccacactgcttctcagtgatcttcacagtccttacagaatctgtgctcaggaaggtcctttgaaaatctgccctgcactgagctggaaaggtacaaggtgactgggaactgtctgaccaggtagccagctttctatgctagccttcttctcagtactggctattttttccctaacaaatgaagaaataaaaattatgtaacacaaaaatgttcagcatgtgtaaatagttacacaagagaaaataaaaggcttgccacaacaccttcaaagagccagccttaatatgaatgccaaatttttatcattccttcaaaattatttctcctattaaatgcaagtccctccattaaagccacattggctcatttagtcaaccactctcctagccttaggcagcacacacttttcaacttcttctcatgtaaccctcttggctactgggaatgctacaaaacccacttcaaagcatgtgaaaggcgggaacaggatctacatggccaaaaggaaaagattccagggatgaagtaagatatgaagtttggagaggaagatgaaagcatttataaacatttttgcaaatgcattagtaccagcaaattgaagatgaaacagaatgaaaaacaaaaatctaagtgtatctctggcattccaatcaaaaactctttccaggaacctgattattcaagggtcccaaaattcaggaagatttaaattagaagattttggttcctagacatgcataatccaaccttcagggttatttcatgtacattttctccttttgattttcatgacaatcctatacgatacacaaagccagtggtaatatactcattttgcaggtaagaaaaccaagacgagtcaagtttataaattgctggagaatccacatatgatctaggatcaaaccaagatttcctgctgccaactcggaagagtttttgctctgctgtactgcattttaactttatttttacattttgaagtatgaatcacattctctactcttccctttctgttcaaatagggcttatgtaaagaaagcctttgaaaaccatagctcaggcatgaaataactagggaaacagaaatgttggctgaggtggtcaatctttctatagaagtagttacatgacagatgacaagttgtaagatatatgtggggtggtaaatgtgggctatttatttacaagcctgcatgaaacctggattaatatatggctctagtcactcttctccatgttccacatgaaagcatttttcctgaccctctactccttgtcaaactcacaatcgtgtggcacatgctggaactcaatggataccatgcaatgacaaagtcatctaaaataggcatggtgtttggcaagaagtctgctctttacccctctgtctggttaaatctttctcatcctttaagtctatggtctagacaagataccccatccagaatcctcccttgattccttagcactctgacccctattgtagcagctgcccatcccatcttactggggcagtccacttgttgtaatcccctgtttagtctgtctccaccaacagactctcagctccaaaaggcaaactctttaaatactggaatggggcctaacatagagcagccaccagtaatgcttattgaacaattacttcaataacttcaattagggttcaaatataccaaagatgcccatttagaaatgcactgagacatctactcttagtggggtgtcataggcagaatcttggcccctgtcattttgttccctactgttacacccattaatatattatgttacctggcaaaagggactttgcaaacataattaaggtcactgacgagctttgcctttaaaacaggcaaattatcctggattattctggcgggactaacataatcatctgagttcttaaaagcagaaaaggaagtgagagcgatgtgaagcataagaatgcagtctgccattgctgagttgaaaatggagcggccacgtggaaaacacaagaaggcaatcaattctgccaacaaccaggagcttggaaggggagcctgagtcctggataaggactgcagcctcagctgcttaaccgaatttcaacctgtgagaccctgagcagagaatctagctagaattctaacctacagaaactgagataataaacatgtgatattttaagctgccacctctgtgtaattcgttatggcggcaatagaaaactaacgcgggggattccccagatgtagcggactctaacccaggatttgactgtaagacttcaattggaaagttgacagccttgtcaaaactggtaagggggtaaagaagtgagccagaaaaggaaaggaagccaatgcaaaatgccttcgtgagtaagcaggttaccactctaagaaacggagctcagtcccactgggagcctctggaaaacctaccagactgcctcaggtatcttcttagagggtaggcagctgggattctgctccaccagttctcacctggcattggtggaggactgctcccagggactttaactctgcagcactctagcctttttatattttcttctcccttgcagtctttcagactttcagaggaaagcaatctgataacataattcctcagaaagtattaatatgacttagagaaaatgtgcaatggttaaccttctcaacagtgaatcccaaatgggggaattttaagcgtgtatcggatgggagaggctttcctagtctccctactacatctccctactcccaagcctccatccctacttgctgctgcatctgctggcaaggcttgtctgtcctgaaagctgctgaaagttagcatttactagtgacatcacttagtgaatatgagtgtgagccttatcaaaactgtgacccatgtggccccactccataccaatgtgcacatctttaaccactttgggcatcttgaatgaaagccacatagatacaaagcattattcccatttactagtaatgatggtaataaatccaaagaacaagaacaaaacctgatgcttggggacattctgagtatgtagcagactccttgaaggaactcatttcttagcacaagcataactgcacttatgccagatgcaatctcatttccgcacataattcccattgttttaagacaattcaaatcccatctttcctcagaggaaaggctgtgattgcaaaacaggagttttttacagcagggataaattgggttattctacagaactattttatctggggaaaacaaaaacaaaaacaaaaaaaaacgaaaaacaccccaagcaggcaaagcaggcctaaaggagactcctgtaggttgctatggacaatcagacctggccaggtagaaattccttacataaatcctgaaagagacttgaaaagattttctgctgtctggcatgtgcagcagtgcagagaaagtgacgagtgagctacctgactgtcaaatgtgtcaagattcctcagaatattcacatcagaggctagtctcaggctccactgagcacacgatgcttcaaataaccactttcaaaggtaaggcttgtaggacaggagggggtttctacccgtctccaataatgtgggttattcactacttgctagaccctggtttaagcaccattcacgcaataactcacaaccaccttctactattattcttatccccattttgctcccaagtgaggctcttgatcaggtcactttcccaaggtcaaaacaactgagatctgaacccagctctgacttgctactctggtccctgttgcaatcatttccaagcttttagtgtttcacatctaacgtgcacaggttcaggaaacaaatggctgagcctttccagcagtgaggtgggcagccctctgctgcctctcagccttgacttgtgccacagcatccccaattggacactcctgagagttcacccaagggatgggcggccttcagctcatcacgtctaacctctcctctttcattctagaaagcatttcaggttgcaaataagcgatatttatattgtcataagaataaccctgaattgactcatatatttattagaaagtcaactactcccaaacctcggttgaggcactaatgtgtaggggttatctccttgggctcaggggccaaaagaacttctgaattcacctgctttattcacaagtcacttgcaaggcaaagcagttaagttatctgagtctcagtttcttcatctgtcaggtagaccattttatagtatccgttcatggtgaggatcaaatgaaataacgcacgtaaagagctctgaacaatatctggaacacaaacagccttcagtaaatgttagtctcattatcaccattatcatcttattattttctgtagtggcaaacctccagctgatgaggacagagcagctccaggtgagttaaaggaacagccttccagttctctgactggatgaagtctcaaacttggcctctccttattgacctttcgagccagccatttgactgcttgtcagcacctctttcacgaggcacctcacttctgggggatcataagtaagatttaaggtctgaacgatgggactgtcaagtgaaattcctcctttcttttggcaaaacagccaagaccttccagagctgtcctggaaggagaccataccctgaatgtttcaatacattatggtgacatttatgcaacacggattctgtgtgccaagctccacactcagagctggggcctcacagccaaatcagcctagtccctgccctgggtaaaagcatagtgaagtgcctctcatttcatcagaatagagtaggagtctgaaatagtcaataaatcctaaaagtcagaattaaaaaacagtacagtactactaacttttatacctcgatgaatgatatcaatgtatatctcactccagatcaaatattcagcaattatcaaatgctattacactgataagatttctatgaaacacacagtacaacagtataagaatgtttcttctttcaaaagaaaaacagaaacacagaagctgaccttctgctcagatgaatctaggtgtgaactctcactggctacttgcaagctgggatacttagcaagtgacctaactatcttgactttgttctccacttctgcaagatggaggcattgacaccaccaaccacagaggggtgctacgtgtgtgcaatgtgacaaggcagctgaagcacttagcacaatgcctagcattcaccaattgttagaaatgcttcttatttttaaagtgcctccaaactcactacatagattcactggcaacaattcagcaaagaaacttctaatggattcagagaaggaatacgtttaatattttctaatggaaagcatttcagagttaatgtatataacttgtttccgcaagtccacaagtatctttatgtctacttgggcacataggaaggaacaagcttttacagataccagagtaccttgcaagattggctggcactggtgcaagctagtgtgggtcactccatagaaattcatttttctgcactagctcttaatggtccttctctgctgggcattttcggctatggtttaaagtaaatgcattcaaataaacatcttttggtgccagaaatgccatgggcacatacttttctttcaatggtcctgggaagtggtttgttaaactattgttctcgattaaaaactcgtgtgtttgttcagtccaatatgggtcaccgctttgagtgaaagatcccttgacatggcaaaacctcgacttgtgacaagccagtgccaagtatgtcttaaccagatgcaggccagggtttgattagcagccactgaattccatgtaaaatcagataatgatggtttttcgcctttctgttgagcaaatatcctcagcttttaatcaagtctatacatgaaaactcctctataaataactttatgcagtacaatggttttaaaactatggttcatctcaactttcctgacctttgactgcttaatctgagaagaacctgtgcaataccaactaaaaataaaggaactacactatttattttggcagattccataaagatataatagagggacatgtggtgagtggaaattctctaccacacacagagagaaaagaaaggaaaggctctggagcccatttttgttctcccacttgtgggatagcatctattagacaatgatgatattaggacggcagagacaagtgccgctttggaatgctgcaccagactccatggccatgcacagaagccttctctgccccgtttgatgtccaaagggtccaactcaaacctgggaaacatgaaccttttcagagaggctggggtctcagcctgggcttcctctcctttcttgtgggtacaatttgggcatctgaagttaattacttgcaggtgcattttggctgcgtgcaatggaggggggttcccaattagcctcttgcaggtgtaattagcaatttcacctcactttgagggggcaagtggataattgtgcccatgaggttgttcctaaaggggtctagcagaatgcccattgcagactgctgtctggagaataagctccatgaaatgggatgctgagcattcaggagtaagtgtcaggtgtccacgtggggtctagaagtggagccccacatggagggtggggttaggagttccttctggttcttcacatccataaaagagagtggagccacaaaacagcattgagaaacaaggacctcaggcagactctctgaggcataagggagtaaatactttggcctgatgacattgagtaatgcaagaaaaactagctcagaacgggagtggaccagaactacagaattaacattttgtagaacaaaaaaagcaaagcaactcagtgaaaataaattattattaactttgccataagccttacacttaaagtgttgtcacagaaatcaactcacgtgagctcataaacttagttataatattcaaaattttaataacaacacttactgagcacttatggtgtctgaccttattctgaaagcgtgtgtgtattcaaccgatgctcttaacagactgctttaaagactcgctctacccattttaaagaagataaattgaggcacagggagatcaggtagcatacccaaggttacacagcgagtaagtagtggagccagatctccaagccgggcagggcaccagataggtcactactctgggtgagaaaatgttcaaacaagaagatggaatcagggagttgaggcttgctctgcaggatgcatctatacaaaatcattaattgcttcattcatttgttcaaccatctgatcactcaaggaacatttagtgagccctgggccaagctactgcgctggcataagtgtaacggagagggagacagccttcttagccccagtgtcaggctaatgttttataacttgaaggtttccttggctgcttgttcagtgttgggaagaaaaatgggagagagcaagagaagaaggaaggaaacagaatgaggaaaagagacaggtatgaagggtgctagagcgtgtgaagaaggggtaaaaaaaagaaaccttcaaaatgagtttttcttctgaaaatgaatccttttatgagggggagaggagaaaccacatcaactgaacagtgagattagactgatgaatgtggaggagaaaccctactgttcctccagatgattgcttgctttaacaagaataggtgtgcaataggactgccaaaagttattccccatgttaaaatctgaaaaccaaaatgaccccatctctggctcgccggccactgtggtctgtagaggggctaattctgagcacttgagttctgggaaacccatcaaacacgtggaaatgagcttgatgagaatcgctagatgtgaaggggctgagtgctactaagacaaattccactgccccattcccttactgaccaaccacctatattttatcatttttattgaagcacactttaccagcgtcattacatattaacctgtgttgagattgaaacagaagattcacagtgatgcaccctaaaggatgtgcaaaacttgagagaacaccaggaccaaaagaaacctaacttgttttctgacaaagctgatggtcattctaacaagagctgatgtagcatgcatgcaaatgtctcacagggaccaccattcagtcctcatgatgaacttatgaacagctatgactccattaacctaataacacctaatacatacatattgagagcttctgtgtgtcccacactgtgcaaggccctttatggagactatctgatgatggagaatatctctcaataatcagtagattaccataggctggggctcagagaagtcccacaccttgcctaaggtcacacagctggcaggtgtcaggacagagagagaatgtgtacattcaggtgtgttcatgctatgctcccagcattcacatggagttggttaaaaaatgatctttcctttgatgtttcctaagacttcatttaaaacttcagatttttttttctttttctgagagggtgtaaaggatattttcactgtaaaagtcccctttgctttactggtttcattaagtagctgggcatttattctattggcttattaaagccttgcaagtgtacatttttaaatgttctgagatttgaaattgacatggtgcagttgttcaagagattgtgaacttggcatagcgttagtcatcaaagaagttttgactttggcatggtgatagtcttccaaaatatttccttttaagatcctcacttattctaaaaagacttaaaatcaactaacacatggggcctgtttctgaaatttatgttgctacaatataatcttcaagttagtcctttagggctaagacctgttacaccccttaattaaattatcttgttttattatgtacagcaatgaaagtagggactcggtgacccactcagtgagcatgcttaattggttttttcatcctcatcatggttcttatcaccagctggactgttctgacttacaagaatttttttttcttttttttcttttttttttttttgagacggagtctcgctctgtcgcccaggctggagtgcagtggcgcaatcttggctcactgcaagctccgcctcctgggttcacgccattctcctacctcagcctccccgagtagctgggactacaggcacccgccactctcctacctcagcctcccgagtagctgggactacaggcacccgccactatgcccggctaattttttgtatttttggtagagacggggtttcaccgcgttagccaggatggtcgcgatctcctgacctcgtgatccacccgcctcggcctcccaaagtgctgtgattacaggcgtgagccgccgcaccgagccccaagaatttttaatagccatcatgctgcctagactcgtcatggcaaaccccttcttctttttcttcattcgccaatcacacatggctttgccaatatcatctgggctaaactaatgaggtcaggaattgtgcagtgcctttcatttctattttaaaagacatgaaggagtcatttggcctctttgtgctgagttagtagagcaaaactgggtccactcaattacattttaagtccattgtaattgagctggcttcatgagagagctggcctcatgagaaagctggccatgggcactcacccatctgagtgatttgaagtgacctcagagagttcacttgctccaaggctttaaattcccatcattcaagctggaccacatgcaatgttcttttaaaatcccaatatcctcccagagggagtacattttctgccttcatagtgttcacctcttgtctttgttatcccagtacccttcatactttggcaaatggccttcctaccataccctgctgtcctggtaaacatcttaggcatgggtccccctcctccctgtctcagggtgggcattttacccagcctgagtcattcatagtgcatgcccctcctcctcctcacccccacaacaaatgattggtttagacatgggctttgagagggacggagaaggaagtcaatgacctggcctactggaattgagaagctttctctaaatccatagatgagtagcccaaatgcaaaagaggggacacagggtatggcagatactataacatactacttactaaactcattttttcttcttcctggtttcattttccagatcccatcgctcccatagggagccatatgactgacttctgtttaatgaagagtgagtgaaaatgacgtgccccacttccagtacagccctcaaattcccaattgtattagtttacttgggctgccataacaagataccacagactaggggacttgaacaacagaaacttatttcttcacagtctggaggctagacatccaagatcaaggtgtcggcagattcagtttctcctgaggcctctctcctttggcttgcagatggccaccttcttgctgtgtcctcacatggtcttttctctgtgcacatgtaaccctgctacctctatgcatgtcccattttcttcttcttctaaggatgtcagtcatattggattagggccctcctgaacaagctaattttaacttaattttctctttaaagacctaacctctaaacacagtcatagtctgagagaccaggatttgggcctacaacatagaattgagggggtggccaaaattttgcctctaatactattcgtgattctccaggctctctccatttctaccatctggatatcaacacacaagtggaactggaagctgtgagttgaagatggccaaccttccatcatccaggcccccataacacccatgtcagaacagagactcctgttaacctggaccttccttggactgtttatatgagcaaaaataaactcccatatgagtaagaaaaaaactcctgtatgttttagcatttatacatttttgggtctatgtgttaaagcagttagttgactccaactaatatacagggcaaagcattttttgacattttgccaaaagtcagcctgggtggaatgattatttatgttgaggattctgagagttcccacaacactttatcacttctagtgttatcacatggtttacatcagtgtttctcaaagtgttgtaaaagtatggattcctgagcctcaacccacatctgctaatcaaaatttcagtgccttttgggggccctgcatttttaataagcctatatgtcactcagatgcacattaaactttaagaagcattggcttacactgtggatcccgttctaaatttaaatgaacattgaatgggtatagcaaagcttctcctgcccaaacgtggttagccgttgagataagtgtttagattttctccacaaattacagaacatgttcattcatttttgtttcctctctattttagataagccaaataactcatttttccccttaatcatcactattttatgatgatttaccaccaaattgaggtctcaggtagagtcaccattttttttatcatgatgtattttagtaactttcaattaaaactagatttacaattgacacagaagttcacccagggagtaccacagggcaagaacctggaattcttccttgtgtcttcatttcaaactgtgagcagggttgcttagttctcagtgttaacaatttcagatccaggctgaggaagagcagtcaattaccctgaaaaatactcctcctccattttatacctgagtcttgggctggcattttccaacatgtgacagtaactccttagggttttaattactaacaaataaaacggttatatggtcaaagtaattgaaaaatacaatatacagtttaacagatttctttatctaatgattatgatctgaacctccaagggtacaacacaatgtccaaattttccagacttgccacaaagagtttgtgtgtgcatatgtttgtatatctggatgtctgcataactatttaaaatatcactattcttcagtacacaaatatccatctaaaagtcactaataatttttatttgagataatatcatggctgtttttttcaatggacatagttacttctgaattttttctaacattagaaccattattaatgtataatcatcctttaagtcctgtgataatttcagccatctctcaaaagtattttaccctctgctgagaaattaatatttcatctgtggtgatattacactaaagttaatataaagttatgaaaactgaaaaactactatatttgctagtattagtatcattattgtgtttgttgtttttgttttaattattattatttataacatcattattcctatctctacacctcttttacatgttggattctgaacatttttctttctggggaagttgaagttaaaaaaaattaaaaacaaaacaaaacaaaagaaggaaggagaaaggaaggaaggaaagacagagggagggaaggagggagggagggaaggaaggaggaagagaggaaggaagggaggaagggagggagggaggacatattgctacaaaaaccgcagagcttcacagagtccttggtatctcatgagtataaaggtggttgtgaacagcaataaaagctactttaactgaagcaatactggcaaattacaaagttgggtggatggcaaacaccagcacacttgtcttcattctgtcctcttgtgccatagcaggaaagaacaatcaatccaggacagctctagtgtacttggcctcaaaatgactgtgaatgcagtgctccaggaagccactacagaacagtcagaattagggctccagctgacctctattactgagtagttgtaatttccaggagtctaccagaatctggactcagaataccttaagttgaagcctatttgacactggcaaatgaagtaacttccctaagcctgaattgcccatctaacaaaaaggaatgttaacagcgtatatattataggttgttgtgaggttaaaacgtgaactagttcttgtaatgcacataatgcaaagcctgacaataatcattgtttaacaatttccattcattgtttactgtatcagatataccaccctccccattttacaaaaggctaaaacagacccagagagtgtcttaaaccatgccaaactaatgaagtctaaattcctgatttccacttcagttttttctcctccatattcattcggtagaaagtctgttttacacttatttatctatttagaagtgtatttgttgtcttactttgtcataactatttggataattccaaaaagatttaaaatagctttcaaatggaagactggcgaggcacattgtgctctgggaggggttccaactctcctgcccaattctcctggagggcagtggttatcactgaagagccggctgaagtgagaggccaccaagcagagcacagcctgtttcattttaatagcagcctcactttacttcttactgacaatgccctcctttacattagctataacctcagatggctgccttaacaaaaggaagtaacacggtctaattgttctggatttatctgtaacaactccctcttgagtaaggagcattctttcggtattcctgctgcatgtgattcctggcctttttccagtatatttagtcattccctcattgtaaggaaagaaaataaaggaagaagaaaagaaaagaaagaaagagggagaaagagaaagaaacagagagaaagaaagaaagagaggagaaaaagaaaaaaggaagagaaagaaagaaagaaagaagaaagagaaaaagaaagagggacggaggaggagatgaaagtaagaagaaagagacagaaagaaagaaaaagataaagagagaaaaagagagaaagagggaagaaaagagagggagggagggaggaagaaaggaagagaagggggaaaaagaggaaatgatagtcacatggtcataatcaacccctaccttgcttctacaaatgctatatctgataattcataaatgccactgcacatgtgggtaaagatgttgattgaataatcactacacaaatttaatcagtctgtttttcatggggaaaacttgggcacaatgtaaatcaagttgttgtttgttgttttaatatgtctatttcccatataatgagcagaaatcttccctgaaaccatgatcctacctttcccatggtacctgggtccctgtgaattctacatctcttcatcctccacactgacaaacgcttggacttaagccttcaaaaatgccagtaactgtatgactagtaaaccagacatagaaaagtactacaacccatgataaatacaaagcccctcatgagagactgtcatttgggatattcacaaaactgttccactcagcagcaacgttgagaagccagacaacatcgcctgtgttcagcacgtccatcgccactgcggccaagccgatggaaaccagctggaaagttgtcagccattttaaacactcagctagagtcactgtcgtgctaccaactgtgaccgtctggaaaaatcacgtaagtacaaagaggcacgaaagaataaattctgaactccacttttaaagaacacagggaaagctgcacaatggcaggcagcatttaactctttaggccctgagacttccattgctggccatggtggagtggcccaccacagaccagctctcttactcattacagctaaacattccggacaaaatacaaacgcaaattcctgaaggctccaaaagtgatgtgccaggagcaaccacaaaataaaaattcctggggaaacctgtctttctggccatagacctggggaaagagacccctgaggtccaaagagtaggggagaaaatccctattttgttcttccttttttctcctccagctttgcctaaaggcggagtgtagctggcagcaggggcagcaggggcagcaggggcagcaggggcagcaggcagttaaacccccaagaaaaatcccgtccttctattagaggactgcaaaagagggccctgtgggctgcagactgtgaagtgaatcctggagggaaaagagctgaagatgaaaatttcataagttcatgtatgagcttgcaaaatgatcagtctcatccctaagctgtgcatgtgtacaatagatctaaagacttgaaaacttaatggacactgagacaactaccaccaaaggtaagacagacttgtggtaggaacctaaccaggttgactgctaagaaaaaaaaaaaattcaatattctctacaggattttagcaggaccaagagtctaaactacacaatgttcaaaatattcaggcctggtgaggtggctcatgcctataatcccagcactttgggaggctgacgtaggcaaatgacttgagccaagaattccagaccagcttggtcaacatagtgagatcctgtctctataaaaaaattagctgagtgtgatgggacatgcctgcagtcccagctactcaggaggctaatgtgggaggatcgattgagcccaggaagttgaggctgcactgaggcatgattgtgtcactgtactccagcctgggcaacagagcaagaccctctctcaaaaaaaatttagaatccttgacatataaaaaataggaaagtgtaaccaattttgaaaggaaaagatgatcaacagatgccaaccccaagattactcagatattgacaatatcagacaaagactttaaagcaactattataactatgctcctaagataaagattgatacatttcaaataaatggaaagatcgatctcagaagagaaataaaaagaaaatatacaaatttttaaaaattgttggatatctcaatagcagaatggaaacggtcatgaagtcatgaaacttgaagacagatcaacagaaatcatccaatccaaaaaataaaagtggagaaaaaaattaacaaaacataaatagagcctcagaaacctgtagaacaatatcaaaatatattttttctttaatgagatggggtctccctctgtcacctagagtgcagtgcataattacgtcttactgaagtttcaacctcctggactcaagctatcctcccatttcagctatcaaagtggctgggaccacaggtgtgcaccaccacatccagttaattgctttttaaaattttttgtaaagatggtgtctcactatattgcccaggctggtctcatctcaaactcctgggctcaagtgatcctcctgcctcagcctcccaaagtactgagattacaggtataatacaccacacctgccccaaaatatcgaacatttgtgtcattggaatcacagaagaagaaaaagagtgcagtgctgaaaaaatatttgaagaaaaaataataactgaaacttctgaaatttggtaatagacataaatatacaactcaaaaagtagagccaacttcaaacaggagaaacaaacaaacaaacaaaaaaacccacctgcagctacatccaaatcaaactgctaaaaacaaaaggtcaaacaaacaaataacaaacaaaaataggcttcaaagcagttacagaaaaatgacgttacacagaagaaaacaatgactgaaatgactgtgtacctctctcagaaatcactgaagacagaaaacaatggaacaatttttttaaatcctgacataaagaaactgtcaactgagaattctacagccagcaaaaatatgcttcaggactgaagatgaaacatgataaaggcaaattcagagaatttatcaatggcagacctactctaaaaaaatgatgttaaaaagttgctcagactaaagagaaatgcagaaattcagaaacgaaggacattcaacagcaactgcaaatatcttggaaatataatggactatttttctccttttagggccttcaaactacgtatgattgctaaatgtaaaaatgataatattgtcttgggagggggtttcaatgtacatatataatacatttgacaaataggaaagtgaggataattataaggttgtgaggtttctcaatttacttgaagtagtaaaatattaactctaagtagactatgaaaggttaggtacctgtatagtaatctctaaaataatcactaaaaatgcaaagaggctgggtacagtgactcacacctataatcccagaactttggaagtctgaggtgggaggatgacttgaacccaggagtctgagatcagcttgggcaacatagcaagaccccatttctaaaaaattataaaaaactaaccaggtatgatgctatgtgcctgtagcctcagctacctgagaggctgaggcagtaggatcccttgaccccaggaatttgaggctgcagtgagctaggattgcaccactgaactccagtctgagtggcagagtgacaccccatttctttaaaaactaaaataaaacaaatagatatagtcaaaagtcaatagataaattaaaatagaatattaaaaatattaaaataaggtagctgcagtggttcacacttgtaatcccagtactttgggaggccaagacaggaaggttgtttgaagccaggagttcaagaccagcctaggcaacatgacaagacccctctctacaaaaaaaaaaaaaaatttaattagccaggcagggtggcacaatgctggagtcctagctacttaggaggctaaggtgggagaactggtcaagcccagaagtgtaagactacagtgagttgtgatggtgccactgtacttcagactgggtgacagagcaagatctgaacttcgaaggaaagaagaggggaggggaaggaaggggaggggaggggagagaaggggaggggaagggaagggaagggaaggaaggggaggggaggggagggaaggggaggggaagggaagggaagggagggaaggggaggggagaggagggaagggcaggaaatccaaataatctaaaataagtctcaaaggggagaaagaggaacaaaattaaaggaggcaggggaaaacacataataaaatggtaaacctaaataaaatcatatcaaggattataatagtctaaacatatcaattaaaagacagaacctggtcgggcagccaagatggccgaataggaacaactccggtctacagctcccagcatgagtgacacagaagatgggtgatttctgcatttccatctgaggtaccgcgttcatcccactagggccagagagtgggtgcaggacagtgggtacaacgcaccgtgtgtgagtcgaagcagggcgaggcattgcctcactcgggaagtgcaaggggccaaggagttcactttcctagtcaaagaaaggggtgacagacggcacctggaaaatcgggtcactcccacccgaatactgtgcttttccaacgggcttaaaaaacggcacaccaggagattacatcccgcacatggctcagagggtcctacgtccacggagtttcactgattgctggcacagcagtctgagatcaaactgcacgtcagcagcgaggctgggggaggggcgcccgccattgcccaggcttacttaggtaaacaaagcagcctggaggctcgaactgggtggagcccaccacaactcaaggaggcctgcctgcctctataggctccaactctgggggcagggcacggacaaacaaaaagacagcagtaacctctgcagacttaaatgtccctgtctgacagctttgaagaaagcagtggttctcccagcacacagctggagatctgagaacaggcagactgcctcctcaagtgggtccctgacccctgacccctgagcagcctaactggaaggcatcccccagtaggggcagactgacacttcacacggccgggtactcctctgagacaaaacttccagaggaacgatcagacagcagcattcacggttcacgaaaatccgctgttctgcagccactgctgcggatacccaggcaaacagggtctggagtggacctctagcaaactccaacagacctgcagctgagggtcctgtgtgttagaaggaaaactaacaaacagaaagaatatccacaccaaaaacctatctgtacatcaccatcatcaaagaccaaaaatagataaaaccacaaagatggggagaaaacagagcagaaaaactggaaactctaaaaagcagagcgcctctcctccttcaaaggaacgcagttcctcaccagcaacggaacaaagctggacggagaataactttgacgagttgagagaagaaggcctcagacgatcaaactactctgagctacaggaggaaattcaaaccaaaggcaaagaagttaaaaactttgaaaacaatttagacgaatgtataactagaataaccaatacagagaagtgcttaaaggagctgatggagctgaaagccaaggctcgagaactacatgaagaatgtaaaggcctcaggagccaatgcgatcaactggaagaaagggtatcagtgatggaagatgaaatgaatgaaatgaagcaagaagggaagtttagagaaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccctaatctagcaaggcagaccaacattcagattcaggaaatacagagaacaccacaaagatactcctcgagaagagcaactccaagacacataattgtcagattcaacaaagtggaaatgaaggaaaaaatattaagggcagccagagagaaaggtcgggttacccacaaagggaatcccatcagactaacagcggatctctcggcagaaactctacaagccagaagagagtgggggccaatattcaacattcttaaagaaaagaattttcaacccagaatttcatatccagccaaactaagcttcagaagtgaaggagaaataaactcctttacagacaagcaaatgctgagagattttgtcatcaccaggcctgccctaaaagagctcctgaaggaagcactaaacatggaaaggaacaactggtaccaaccactgcaaaatcatgccaaattgtaaagaccatcgaggctaggaagaaactgcatcaactaacgagcaaaatcaccagctaacatcataatgacaggatcaaattcacacataacaatattaactttaaatgtaaatggacaaaatgctccaattaaaagacacagactggcaaactggataaagagtcaagacccatctgtctgctgtattcaggaaatccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacgttagacagatgaacaagacagaaagttaacaaggatacccaggaattgaactcagctctgcaccaagtggacctaatagacatctacagaactctccaccccaaatcaacagaatatacatttttttcagcaccacaccacacctattccaaaattgaccacacagttggaagtaaagctctcctcagcaaatgtaaaagaacagaagttataacaaatggtctctcagaccacagtgcaatcaaactagaactcaggattaagaaactcactcaaaaccactcaactacatggaaactcaaaaacctgctcctgaatgactactgggtacataatgaaatgaaggcagaaataaagatgttctttgaaaccaacgagaacaaagacacaacatacaagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaactcacagcagaactgaaggaaatagagacacaaaaaacccttcaaaaccaggagctggttttttgaaaggatcaacaaaactgatagaccactagcaagactaataaagaagaaaagagagaagaatcaaatagacgcaataaaaaatgatcaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtgaccataatcaatagcttaccaacaaaaaaaagagtccaggaccagatggattcacagccgaattctaccagaggtacaaggaggaactggtaccattccttctgaaactattccaacgaacagaaaaagagggaatcctccctaactcattttatgaggccagcatcatcctgataccaaacctgggcagagacacaaccaaaaaagggaattttagaccaatatccttgatgaacattgatgcaaaaatcctcaatgaaatactggcaaactgaatccagcaacacatcaaaaagcttatccaccatgatcaagtgggcttcattcctgggatgcaaggctggttcaatatactcaaatcaataaatgtaatccagcatataaacagaaccaaagacaaaaaccacatgattatctcaatagatgcagaaaaggcctttgacaaaattcaacaatgcttcatgctaaaaactctcaataaattaggtattggtgggatgtatctcaaaataataagagctatctatgaaaaacacacagccaatatcatactgaaggggcaaaaactggaagcattccctttgaaaactggcacaagacagggatgccctctctcaccactcctattcagtatagtgttggaagttctggccagggcgattaggcaggagaaggaaataaagggtattcaattaggaaaagaggaagtcagattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgtttcaaagagaataaaatacctaggactccaacttacaagggatgtgaaggacctcttcaaggagaactacaaaccactgctcaatgaaataaaagaggatacaaacaaatggaagaacattccatgctcctgggtagaaagaatcaatatcgtgaaaatggccatactgcccaaggtaatttatagattcaatgccatccccatcaagttaacaatgactttcttcacagaattggaaaaaactactttaaagttcacatggaaccaaaaaacagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccgcttatctacaattatatgatctttgacaaacctgagaaaaacaagcaatggggaaaggattctctatttaataaatggtgctgggaaaactggctagccatatgtagaaagctgaaactggatcccttccttacaccttataccaaaattaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactacgatgagagtgaacaggcaacctataaaatgggagaaaattttcccaacctactcatctgacaaagggctgatatccagaatctacaatgaactcaaacaaatttacaagaaaaaaactaacaaccccatcaaaaagtgggcgaaggatatgaacagacatttctcaaaagaagagatttatgcagccaaaacacacatgaaaaaatgctcaccatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattgtggaagtcagtgtggtgttcctcagggatctagaaatagaaataccatttgatccagccatcccattactgggtatatacccaaaggattataaatcatgccactataaagacacgtgcacatgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgcagggacatggatgaaactggaaatcatcattctcagcaaactgtcgcaaggacaaaaaaccaaataccacatgttctcactcataggtgggaaatgaacaatgagatcacatggacacaggaaggggaacatcacactctggggactgttgtggggtggggggaggggtagggatagcattaggagatatacctaattctaaatgacgagttaatgggtacagcacaccagcatggcacatgcatacctatgtaaaaagcctgcacgttgtgcacatgtaccctataacttaaagtgtaataaaaaaaaagacagaacccgccagagtaaattaaaaaaacaaaaccctactgtgtgctgtctatgagaaacccacttcaaatataaagatatacacagattaaatgtaataaaaatgggaaacatataccatacaaaaactaaagggaaaaaaagctgcagtggctacattaatatcagacaaagtcaatttcagaacaaacagtattaccaggaattaaaaaaaaagagtccctagtaataaaagataatcattacataattatgaggttacaacaatattacacatttatgtacttaataatagagcttcaggaaacatcaagcagaaacagaattgaaaaaaaaacattattttactttggactttaacacttctctctcaataagcaacagaataagtagaaagaaaatcaacaacgggatagaagatctgtgcattattaaccactttgacttaattgacattttagaacactccactcaacaacagcagaatacacattcttttctagtgcacatggaacactgacaaaacagacaaattctgtgtcatagagcaaacctcaagaaatttaaaagaataaagattataaaaagtatgttttctgaccataatagaataaaactaaacatctataccaagaatatatcaaggaaaatccccaaatatttgaaaattaaataacacacttttatataatccacaggctaaaaaggaagtcacaagggaaattagaaaatattttgaactgaatgaaaacacaacatattaaagcatacagaatgtagataaaacagcaattagagagaaattaatagcactaaatgttttattaggaaacaagaaaggtctatcaatcaaattgaaattagaaaaatactaaaatcaaggaaacaaaaagtttgttctttgaaaagatcacttaagttgataaatctctaggcatactgaccaagaaaaaaaggaaggaagacagaaattacttgtatcagaaaggaaaagacaccatcatcattagaaaccctcagacataaatagggaatattacctacaattctatgttcataaatctgacattgatgaaataaaccagtttcttaaaagaaacaaactacaaaagctcactcaaaaagaaatagataaccagaataatgtattaaataataccctgctactcatgaaggtaccataaaatggcagcaacagaaattataaacccacagatccaagaactacaataaacaccaagctcaagaaacatgtgaaaaattaaggcaaggaacatcataaccaaattacttaaaactaatgataaagagaaattttaaaaggagtcagaaaaaaacttataaagaaacaaagataaggataacagaagatttcccaccagacacaataaaagttacaacacagtggagcaacatttttaatataccaaaagaaaaaagaatcagccaaactaggatactcttactacaaaaaattaccttcaaactgaagatgaaataaagacttcttcagctaaaaaaaagcttatagaattcttcactagtagatctgcaccacaaaaaaatgttaaagtctttaagcacaaggaatgtaataccaaacggatattttgatccacaaaaaggaataaagagcaccaaaaatattaactacatgagtaaacataaagatattttatctcatcatttaaacttctaattagccatttaaaacaaacctaataaaaatgtattgtggggttaataacaaaaattaaaatacaatatattacagcaaaagcacaaaagacagaaagaaaaaaatggaaatataataagattcttatgctctacatgaaatggtataatattatttgaagatagagtttaataagttaaagatacatattataaatcctaaagcaaccaccaaaataacaaaacaaagagctatggtgaataaattgccaagataaaggtgaatcaattaaaaatcctcaattaatccaaatcaagacagtaaaaagaggaattaacgaaaagatggggcaaataaaaacaaatagcaagatgacagatttaaatctggccataacaaggaatcacattaaatgtatttggtctaagtacctcaattaaaatgcaaagattttcatactggataaaaaagcaagactcaaatatatgcagtctacaagttatctattgtaaatataaagacagaaataggaaaaaaagtaaaaagctggaaaaataaatatactaacactaattaatcaaaagaaaactggagtggctctattagtatcaaagttgatttccaaataaagaatattagcagggatagggaggatcattttatattgataaaggaatcatttaaccaagaggacataacaatcctaaatgtttatgctcctattaaaagagcttcaaaataagtaaagcagtccccacactaggtgaaaagatttataaatcacatgtgtaataaaggaatcaaatattgactatataaagacctctcaaaactccaaaacaagtaaacaaacaatacaaaatgggcaaaatatatgaacaaacatttcaccaaagaatctaacacaggtgacaattaggcacatgaaaaaatgttcaagttcattagtctttagggaaaggcaaaataaaaccacaattagatacttcaaatcttcaccaacacttggtatggctaaattaaaaggattgaccataccaagtgttggttaagatttgaagaaactggaactctcatacactaatggtgggaaagtaaaatggtacaactactttggaaaacagtcaacgatttcttgaaaagtccagcataccctaccatatgactcagttattcctctctcaggtatttacacaaaagtaaagaaaacatttgtgcataaaaaggcttatagaggaatggtcatagttattttatttaaaatagccctgaaccggaaacaatccaaatgtgcggcaacaaatgaacagacaaatgatatgccaaacctactggcatactagtaggcaataaaaaggtataactattgattcatgtaacatggatgagtgaaaataagcaagtcaaaaaagagtacattgacgattccatttacgtaaaattctaggaattgcaaactactatatagcagagtgacataaagcagatcagtgcttgcctaaagatagagatagaggggtcatggagaggtaggaggaatggattacaaagaggcattaggaaatttggggtagtaatggatatgttcattaacctgactgctttacacctgcatccatatgtcaaaatatatcaagttgtatgcatgaaatatgtataatttattgtatgtcaatcatacctaaataaatttgttaaaacttcaaataataaacttaaataaaacaaatctggctgacacggtttggctgtgttccaacccaaatgtcatcttgaattgtagctcccataattcccatgcgttccatgtgagggacctggtgggaggtaattgaatcatgggggtggatctttcctatgctgttctcatgacagtgaataagtctcacgagatctgatggttttataaatgggacttcccctgcacacactctcttgcctgctgccatgtatgacatgcctttgcttctcgtttgccttctgccatgattgtgaggcctccccagccatgtagaactgtgagtccattaaatgtctttcctttataaattacccagtctcgggtatgtctttattagcagagtgacaatagagtaatacactggcaacaaccaaaacaatacagaaggtaccttttactaggcatttgctatgttctaggtgccatactaaatgcttttcatatcatctaattctttcaaaaaacataaggcaagtgctattatggtttctacatttaaagagaaagactaaggtagagaaaggttaaataatttgcctaaggtcacaacattagaaaggggtaaagctggaatttgattctagagtcaacaatcttaacaaaaacaccatgaggaaactgaaactcaaggaaggccgcatagtgttggggatccatcctagatttgtccaacttcagagcccaacctcttaattgcttcattgtactacatctcgtcttgaaaacatcctgccaaaaacctaatagtcagcctagcctgaacacacctgtgctaattaaatgtgtatttcctggttcccatattcaggaaaaaggggactcacactcagcctttctcagttttcatgtaaccaacaactgttgcgtgaatgaatgaagtgaagtaacttaagttaactagcaaaatgtcctcacattaaaaaaaattaaataaaactggaggaatttgaagctcagaaaaatattaagaatctgcctaaagccaaacagtgagttagtagtggtgaaagtggaagtcaaactcaggttggctaattccagagctagatgactctgtctctccaaaaaaaagatgatcaaaatctgcctgccaaaaaattgcacccttttagacaaccatgagtggctcagaagtgttgaagggctgcagatgagctgagacaagcttacaaaggaatgtgggtgtcccgttccagggacacacaatgaacgttcagctctccttgtctctgaagacaatgcattccaggctcccagccctatttaagagtggaggggttctgctattcagctgtccggcacccctgctatctcaagtttaactagttattttcctttataattcactgtagactgataactattatttccctgtctaacacatactgacaagtgctctggttaaatataggttgctaggaattggggtggaaattttttttttttagctcaactttatcaagggtctgtagactcagaattccagaaccatcccattacctcagtgaaattaacacatagactcagttaaaaaaaaagaacaatttttgttttcccagatctcaagaaagatatggaaaggactgcttggctttctgtcctcctatttcttggttttaaccaagaaacgatcaaacgttagaggttctaacctctaacgatcaaaagtgagttgaggagctttaagagattagttctatgcagaaggaaagcaggtaagaaggacaaggagtgtgtgagagagagagagagaaggagagatcagagtccatgaataaaaatatgcaatgtatttatcaaggctccaaacccacataggactgctggttattgtccaatcttcccttctataattacggacatttagctggcctgtggtatacaacaaaacactaaattttccatttccccacaacacaggatgtagccatgtgactaagtttgggccaaggtatgagcacagcagtgatatacaaagcatccagcctgtgcctttgaaggagaggaatatggtctccattacttctttctcttctcatggttggagcacagactggatagagggagctggaagagccattttggaccaagagatggaaactgtcatgtttttagggtggcagagggataagatagaaggaacctggtttcctgtcaaaccatttagtctgtcctagatggcctacacagactttgatgtaggaagaaactaatacatcagatcatatgagactgataatgaggataaaaatattgaatgatattgatagaaaggagaattttatttcattgccacaaactcttctggaacactcttccccaaccacccaatggtgcaagttcaagaagagatcaaaagtgtgatttattgtcatggacttaaaatctagaaaatatagtcaagttgttgagctatttcaattttcctttgcagcttctttctgaaggcttgaaatattttactttaaatgtggaatgtttgcagggaggactttccaatgctgaaaagcacaagttctcccattccttaatcccactgcaaaaatgtgtggccccaatgtttcatgtcagacctgttggctccttcctttgcaaaggctccagttgttacactaaaatcacactggatcatattagctctctcctcccaatttcctgttcataaagcttggagcctcatcacaatgaatgtattgtaaaaatatagggtaacaaatgttttctgctgggcttcgtaaattggaatgagacaaggattgggcatttacacccaatttacttcagactgtattacctatagaataacttgtgagttctcagataaaagcaaataatggaaaccatgccaaagtaaacgaacatttttgaattcctttcaaatattaaatactgatattttcctccagaaatacaaaaatgcatagctgtgaggtccactttcatgcaatatgtggcatatgctgtctaccactactgttgaaaggttgaacatatgcattctacatatgcctttctactccttggtatatctgcaatagaaatgtaggcaaatgttcatcaaaacacagttagtagaatgtcacagcaacactattcataatagtccccaaatggaaacatacatgaaaaacagaatggtttaaaagaaacattatataattgaagaatggaatacaacaatgagaatgaattgactagaagtacacacaaccagatggatgaatctcacaaacataatgtgtaaaataatccagaagggaaagaatgtttgctgtatgatttcattaacatccagttcaaagccaggcaaaattaatctatggtgtgagaaatcataataattattatctttgagagaaaaaatgactaggaaggcaagacttctacagtgctcaagatgttctgttttttaatctagacattagttacatgggtgtgttcactttgtgaaaatgtacaaaggtgaagtcatatgatttgtacactttcatgcatgcatgctatatctcaatttaaaaaaattaaagggatacatgaattcaaaatgtcacaattgttataacaccaaaataaaagtgtgaaaagattgctactacccttcatctaagacatttacactaaaaaatactatggacatatctatgaaaatgaataagctacatcagaggataaaaagagaccctatagggcagcagtccccagctttttttggcaccagggactggtttcaaggaagacaagttttccacagaccagtgagggggtagtttcagaatgaaagtgttctacctcagatcatcaggcattagattctcataaggagcactcaacccaggttcctcatgagacacaatagggctcacactcctatgagaatctaatgccaccactgatctgataggaggcggagctcaggcagtaatgctcgctcacctgccactcatctcctgctgtgcaacctggttcctaacaggacatggatcagtattgatccagcccagggcttggggactcctgttattaaaaataggcaaaaatgggccaggcgcggtggctcacgcctgtaatcccagcactttgggaggccgaggcgggcggatcacgaggtcaggagatcgagaccatcccggctaaaacggtgaaaccccgtctctgctaataatacaaaaaattagccgggcgtagtggcgggcgcctgtagtcccagctgcttgggaggctgaggcaggagaatgccgtgaacccgggaggcggagcttgcagtgagccgagatcccgccactgcactccagcctgggcgacagagcgagactccgtctcaaaaaaaaaaaaaaaaaaaaaaaggcaaaaatggaaaagtaggacttctttttttaggaaaatctgccaacaacatttgggtctaattctaaaaacataattcaaccccaactgttttacttacaagtagcaattttcactcttaaaccttgccatttgaattacttagaatccattttttgcaatgagtctgaatctataagccagagtccattggcgtataatgaatgcctggaacaccagattcaagaagctacttgcctgtaaaggcaagacaataactcagctcacaggagaccaactaaatttttcaataaggcagccatgtacaccaaaggttgtgcaaatagagcaagcaactgatgaagttcagactaaacacaaatatattagcaaacaccactggggacagaaagttataaggaatatcccagaaagaagggcagcctctgagttggaaatgacttcttacaaggattgatattatatcattctttttttaacttttaagttgggcggtacatgtgcagtttcgttatataggtaacctcatgtcacagggatttattgtacagattatttcatcacccaagtgctaagcctaatacccaatagttattttttctgctcctctccctcatcctacactttaccttcaagtaggttccagagtctgttgtttccttctttgtatcaatgtgttctcatcatttggctccctcttataaatgagaacatatggtatttggttttctcttcctgccttagtttgctaagaataatggcctctagctctatccatgttcctgcaaaggatatgatctcattcttttttatggctacatagtattctatggtgaatatttactacattctctttatccagtctaccactgatgggcatctaggttgattccatgtctttgctattgtgtacagtgctggaatgaacatttgtgtgcacatgcctctatggtagaaagattcatattcttttggatatatacccagtaatgagattgctgggtcaaatggtagttctgtttttagctctttgaggagttgccatactgctttccacaatgattgaactaatttatactcccaccaacagcgtataagtgttcccctttctctgatataagtgttatttcatccttattcattctctctctctctctctctctctttctctctctctctctctctctctctctgcattggttctgatttcaggttacgtctgcattatgtgttttgtcaggagaagggatttcagagagatgtcaggtttccatttcaagatattcaaagcccttaatgagatatttgcctgccctgccactgggaaactcagcagaaagcttgcacagtttgtagggtaaatggcaaagcacaagtgagcaagttccagacccactgcttcatacatctgcctgttatttgtggaggtaatagaaggtcttcttaggcctgacctggaaaccagaaaccatgaagaaatgattggcagatgggaaaacataaatgtcaaaaaggcaaatgtacataacacccacaacacaaacacgctgggaaaatattttcaatgtttctaacaaaggatatatatctttaatatacaaatagatttatcagatgtgccattggatcaaagatcaaaggggaaaatgaggcaattcacaaaggaaaaagtataaatgggagaactttacaggcttataagttataaacctataaagcttttcccattggacataaattaattaaatgaggattttcaccctcctttttattgagagggaggggagccttccacattaaaatgattttgaaaattgccaaagtcactattggcaaaatgtttaggaatggactacctcatatgaattcatagtcatatgcgagggcttgaaatgtgtgatctctaacagcaagaccgggagatacacttgacatccattcacagggagtagttgaataaatcacgatgccacagataaaagtagagtgctccacagctattaaaaacaatgaggtaaagctgtgcatcatcaccagcattgaaactaatgctatgctgggaaccaagctgactgtagtagcaagtactattttaccactttcatataaaattatatacatatggtgccgggaggacagatgaaaaaaagaaggaagaaaggaaagagaaaaagaaaggaagtttcaattattaaaatgttaacaatgattatctctgcatggtggcaatttgggtgattctcacttcattgcttatacatttctgaattactactattattattatttttgagacagagtctcactgtagcacaggctggagtgcggtggtgcgatcacagctcactgcagccttgacctcctgggctcaaatgatcctcctgcctcagcctcccaatcagctgtaaccacagatgtgccaccacgcctggctaattattttattttttgtagagatagggtctcgctatgttgcccaggctggtctccaacctctgggctcaagcatttttgccacctcggcctcccaaagtgctgggattacaggcatgagccaccaagccccagctaggatattatcactttgaaaaaaaacaaaacgtaaccaaaaataacaaaactaagtaactgaaaaaacttcagactccctaggagctcatatttatgcatcatctgaagccgtcttgtcctccttctgccttttcttccaaagtcaatctgtttccatatcctattaattttactcactcaataggtattttatgaagctcctgtgttctctctcctccctctttttcctaattattcttctccaccaggatctatctccaccactgcccacttgggccatcgcctaagcctcttaacttatgcctgtgttttctactgacttctgctcccattcatccttcacaccgcagaggcatcctcgcattacacttttaaaagccttccatgtttccctgtggctccaaattccttatggtggcattccaacttgctggcccatactggcacctccgccgtcatctcccctgcattcactcctatccattctcaactcccaataattgcttgctccgaggatgactcaccattctctaagctcaccacatatgtttttatatttctatatagttggtcatcttgtcctctaagaagctaatgcctgatttccctgattatggaagggaagtttcctgattgtggaaactgattattttccaagattcagatcaaactgaatctcctctaatagcccttgctcaatctttttgtttttgtttggggaaacaaaacaaaacaaaaaacaatcacctttcttagtcactatttcattcttctaagtgtgcccacatcttcttcactacagtgtggagcttttgtgagtggaggcagtttttttgttgttgttgttcaactttttgataccctaacatgcctagtaccagtttttcacatcttaggcacttaaatattttttttcaaaaaacagagacagtgcctgccatctgccaggctctatggtaggtgagtccacagtcaactgttctcaaaacatggtctgcattctgggcacagtcactctcattttctatgtggacaaaactgaggccaagagattcagtaacttgccacagaccacacagtaatggcagatctgagataagagtcccggaccaccatatgaatccagattcttttgactgatctgtgcttcttctgcacatatgtatatggagctggactgatctggacatgtaggaagtgctgactcctaaaatccatttttctaactaagaagtgttcaatgtattcccaggttttaaaatgtctatttgctttaggccagctgaagcatcatctataccctggacctgtggtttctctaagcttctatcaccccaagaacgtcagtgcttgggggtctgtctccaggttaacatcctctttgcacattttaagattttttcccagagctcactttttctagaattcaactccctgccttctctcaaatttggatgtaatagctggcaccgacgcaggaggatgccttgtccattctactgtcagccattctatttccatatcaacaaatgcccatgcccctcttcaatttttacattctaatgatttcaaatttaaatcttccaaggactaagttgagggaaaaatagtccaaagaacaagccacttgccaccatcagaggtaacagtgcttctgggtagcctgagattctgtttgacttcatcaaagtccacaaattccaggactgcccaaattaggagacagccaaggaattgatcttcaccttaaaaacaacaacaataataatgccaatacccaactgtattagtttcctaggattgccataataaattaccgctatggtaacttaaaacaacaaaagtttatcatcttacagttctggaggccagaagtccaaaatcaagatgtcagcagagttggttccttctggaggccctgatggagaaaccattccatgctttttcctaatttctggtgatggccagcaatccttgacattgtttgacttacagatgcattacttctctgcctccacaatctctgcctccaacttcatgcgaacttctggtctgtgtctctgtgtatcttcttcttttctgtctcataagaacatctgtcattggatttagggcccatccaaatataggatgttctcatcttgagatacttacattaattacatctgaaaagacccttattctgaataaagtccattctgaggttccaggtggacatatcttttaaaggctttcattcaactcacaaaccaacactggttgaaagttcactgtgtaacaggcaccattctaaataatgtgtattaagtcattttatctttacaataactggaagaagtaagtaactatttatagaggaagaagataaagacataggaaggcctcccaatcttcctaagacctcatgggtggtaaaagacagagctagtacttaggtgttcatcttcttcataccagggtcaactgttttagatgcatttaccagaatcaaagtgtctaaataacagccaagaccactcctagagagtcacactgttaatctaaaatccctgaactagagaatgttggaaaatatataacatatgggccattgcagcttctacccaatgatgtcagacatcactaattgatcacagagttgttccctatggcaccttaaatgtttacaacattcattatccatcagttcaaggtagcactctgaatgaaacctcctgaccatcctgtttctagatactctttttcaaacacacacacacacacacacacacacacacacacacacacacacacgagagaaccaaagggcaacatttggtctcttcctgtcaagttcctgtcctgccttctagcctgacttcccctgggacttgtatttgccttccaagtctgattgacagagcaagactggatcccatcaaatagcctggagagccagacagaagtccatgctcaaaatccagaccccatcagatgttgtttgaaattcagagactgcagagactgctggcacattcttggaaaagctctgaccttgggaagaaaacttacttccatctctaagaaaaaatactagataatgatttttttaagcccatgctgggagttggtggcaggatgagaatgcacatggtaacaggacaacagtgggtactggcctggagcaggctcctacgtggcctccccagagtccaggctttattctcagcattctctatggtccagcctctctccacttaaactacacttcagataatggtgtttgctacaactctttacaatcaattattttgtcattgtctttatttaaacatgtacacacacacacaactagagggaatgcactggagaatgacacacaacgcattccaaggaaataacaaaattttttctggcttgcgtgcccaacccacaaacttgaagatcaccagggctttatttagtttggttcccattatcattatgtgaggcatgttaataactggactccagagctttggttttagatacttgttcctcacctctctcatctagagttttaaaaaatagtttttattataaatacatattttttgcttttcctgcccacctaacttttaaaaaatccaaaaatcccatctactctcattagagttgaccacaacaaaactgcatgagaaaaaaaaaaaaagaatcctttggatcacatgggtgtcacaccattgttggccatgggagctcagcctaataaggagaagatatgacaacagagagagcccagggtcttgggccctttgcacagaacatggtgtccttactggcagtttgttttaggcttaacatattaatttattgctaaaacaggccgggtacagcggctcacgcctgttaccccagcactttgggaggccaggcgggtggatcacttgaggtcaggagtttgagaccagcctgaccaacatggtgaaacctcatctctactaaaaatacaaaattagctggcgtggtggcgcattcttctaatcccagctactcaggaggctgaggcaggagaattgcttgtacccgggaggcggaggtggcagtgaactgagatcgcaccactacactccagcctgggtgacagggtgagtctctgtctcgaaaacaaaacaaaacaaaaaaactgatgtagtaaaatgtgctttacagtaattacaccacaagaataaactactagcttagaattatttgttgtatttcactaatgccaaagacatagatttttatatgtaatacaaatcccttattttataggtaagataaatatggcccagagggataatcagaactaccaaatgtcacatagccacttagtaacagaagaggcacaacagcaagttctcctagttacagctctacacctcatgacctccatggagccatccaacctgaccaccgggttatctacaagggaattttttaaattaaaaaaaaattcccttgtagataatctagtgatcgggttaaaaattcctttaaaaaaatcttgcagcagaattaatgagggtaaaggtacatggattcttttcttttgactccttccatttttatacctgaagttactccatgagaggaggaactcagtctgcatttactcataactgaactctcaacatttaagacatttcactaaattagtaataaattgatggcagcatagaaatttgtttcaaaattactcaataaaaatacatactgcatttttctccagatattcccccctaaattattggcatagtcattagccctttataggagtttttgaatttggcaccttgacatttggatgggctaatactctgttgcaggaggctgtcctgtgcactacagaatgtttagtagcatcgctggcctctgccctatacatgccagtagcataccttctggttcctccccatcccactgtccagttttaacaacgaaaaatgtctccagttgtcaaatattcctgggtcagggttggggtgggttgtggagcacaatcgcccctggttgagaactcctgatctaaggtgacagcatatccacccaccctcgaccgtccaaccatgtgattcatgggacatggaagcttgatgaatcaaccaactgaaaattaaaagatacacatagaaagcactcaggaggctgggtgtggtggctcatgcctgtaatcccaacactttgagaggctgaggtgggaagaacacttgagctcaggacttcaagacccacctgggtaatatagtgagaccctgtctctacaaaacattaaaaattaaccaggcatagtggtagcatctacaatcccagctacttgggaggctgagaggggaggatgacttgagcccaggaggttgaggctgccatgagtgtcatgattgtgccactgcactccagcctgggagacagagtgagaccctgtctcaaataaacaaagaaaaaaaaagaaagcactagcactcaggaaatataagtatgaattgaattagatatactctaatctgcttatttcaaacatcatcacttttgaagacattatgctaagtgaaataagctggtcacaaaaggtcaaatattgtatgattccacttacttgaaatacttagaggagtcaaattcacagacaaagtataatgtcggctgccaggggccagggagaggaggaacgtgcagttattatagaatgagtgcagagtttcagtttgggaacatgaaaagaattacagaagtgggtggtggtgatggctgcacaacaatgtgaatgtacttaacactactaagctggacacttgaaaacagtgaaaatgataaattttatgttacatgctttgaccacaaggcctaaattagaccaaattatcacaaggcctaattccacaaagcacgaagcaggcccagcgcggcggctcacacctgtaatcccagcactttgggagaccgaggagggccgatcacctgaggtaaggagtttgaaaccagtctggccaatatggtaaaaacccgtcgctactaaaaatacaaaaattagctgggcatggtggcaggcgcctgtagtcccagctacttgggaagctgaggcacgagaatcgcttgaatccgggaggcggaggttgcagtgagctgagattgcgccactgcactccagcccaggtgtcagagtgagactccatcccaggggaaaacaaaataaagcacaaagcacctagataagatttaaaatccccacattctcccataaacttgagtttttgcttttgtagttgttttgttttgttttgttttggttttggtttggtttggtttggtttggtttgacaataaattccttagctaaggaatccaaaagctaagaaaatcttcctcttcatttgtggctgagagcacaggagcagcagagacaaccgcggctctggggcctgctgcagagcagcacaggcacacaccaggacatgggccctcagggaggccccctgatttaagagtcttctcgtgtgaaatgcatccagcccagatcccctaaggacctggcctgtgggtcatgtcagcccagagcccttcctattgccaggatgctcttgacaaaagacagtctggcacggagcagcagggccattattttcatttaaaccatacatgtcatgtcctgtttgtgagaaacatgttaaacaattcagaaacacattcacaatgggctctggagtgggattcgcattcctatgggcctgcatactgtaaactggggatggggaaggaggctggtggggagggtgggatggtgcctctgctcttgttttaacagagagctcctccccggaagctcagctgtaaatagagaccctcacatccttgtttgatgtgggtcttaaagttttcctatggccaaaagcacgatgctcaaagtatgataagccccccattatccatggcagcccagtaacttgaattcctttaagattctctcttaccaatgtttattttaattttgagaaggaaaacaattccactaaggaaacactcaaaaggaggtgaactgccccatttccacctagattgccacagcagatgatccacctgcaatgactaaaaggcatctcagaggtgtaaaccataccaatatgactgaaatctgcgatcctgagccaccccatcacaagagtgtctcagatggaaatgtacacacctataacacacaagatgagaaattcctcattcactgatgaaaggaataaataataaacatggagaaaatcacattcagtcaagtgtaatttgatttacaacgctgttcacttaccaaacatacagtatttatatgcaaacttccaagaaaagtacattctaatatattaaaattagaccccaaatccaggcctttggccaagtcaaataataaacagtgtgataactacgtctgctttcttgccatgacatttctttggtagggggggatgatttaccatttaaaccatacatatcacatcctgtggaagtttttgaaaaattgaacaatttcctctaaatgcttaaaggcagattaactataaagaaaaacagaatcaaacagaataaaagtactgtagaacccattaaaacattaaaggaaactatatagcttattagaacaaatgtggagctagcagatttaaacaatacctgcaaggatttgtcagagatataaaagcaaatgctagaatgccttatttcccttcccatgggactcatactttctttgttgaaatatacaaaaattctgcagtaatttaaattttactttggctttacataaaaaggtgtccctggcctcttaaatgtaactggtgaataataatatatttggccatcgacctccaggctgcagcagtccattctttcctctcttgcccctgtctgtcaaagtagagatgaacactgagcctctgagaaagatggagctcaggctcttcttggcaccactaaaaagaacttcatctttgccttgactacaaatgcaagaggattcctgtcacagacagaacggattctcttgataacaataatcagcattaaaactaaactcaggcctgtggttggttaagtcaccccagttttgtgtctttagacattagccaggcagcaggcttggtagggcccaccaatgctccagtgatactaaggaacagctctcttgcttgagtgatcgatctgctagggcatattccacccagagaagggtttgaaagagagaaagaccaaacgataaactatagatcaggaagaattttgtgactcgtccaatgcagaacagaacaccattcattcttcatcaactaattcattcaatcggcgctgttctgagcaccggagatatagcccaggctctcccagagctttgattacataaagaagactacagacaatgaaaaaataaacaaaacatatatatacacacacatatacacatatatgtataaagacacacatgtatatgtctctgcgtgtatatatacatacacatacaatataatgcatatatacacaatatgatacacacacatacggtgatggtaaatgttaaaaagaaaaatatctatacccaagagaaatgaaaacacatatccacataaaaacttgcacatgaatgttcatagtagtattattcataatagctaaagagcggaaaaaatccaaatgcccatcagctagtgaataaacaaaatgtgatatatctgttcaatagaatattatttggcaataaaaagaaatgaagcattaatacatgctacaacatgcagaaaccttgaaaacattatgctctatgaaacaagacaaacacaaaaggccacatattgtatgattccatttatatggaatgtccagtataggaaaaccatacagacagaaagtagattagtagttgccagagactaaggaaaaggggtaatagacagtaattgcttaatgagtatgagtatttttttgggggtgggggtggttctagaattagatagtggtgatgggttgtactgcaaaataaatgtaccaaaaatcactgaattgtatactttatattggttacaagggtgaattttatttcaattttataaatgttaaaaaagaaaaataaaacagagagggtacgaggacagagggtgacagggaagacactatttagctaatgtggtcagaaagtgtcttggataagctgacagtgaagcaaagaccagaatgtaataaggttatgagccagaaagatacccgcatctttgttctctgccatttctgtctttgtctctccctctccctctccctgtatcattttttttaattgtggcaaatagatgtaacacaaaagttgtcactttaaccatttttaaatatacaattcagtggcatcaatcacattcatagtgttgtacaaccaccactattatctaaaactttttatcacctccaagaaaattgctattcttcttttaatgctactgtcaggccactaatacagaaaacaaaacaaaacaaaaaccatgactaataactagcaagaaaaaaggtgagctgggagcatactttcattgctgttcagtaaagggtaaatgatgatgattacaattgttttacataggctactcaggctccttggagagagagaaagctgggtatggtggaaaaagagatgtctggcaagatcagccttgtagtgagaaggtccttccctcatcatgaaacactcgattttcaatgatttgctgactcatcaagtgtggaccctcatctctgaaatggttgggtacctcttcacatcccatctattctacggaatggacagccatccaaccaaatctaggtctacaaactcccagcctctccttcacctgctccccaaatggtacataacctcaaaaaatacaacagaactattttgctataacttggcattaagccttaataatttatagaaagagcagtaatttttttctcctgaaacttgtgacatataaatatatgtatatacatatacatgcatacacacatagacacatatgccataactaaacctctattttaaaaaggagacatacgctacttaaagataaaaacaagtaaagatggctaacattttattagtttgaactaatatgagttggttcctattaaacacagcattctcagctttattttctcataatgtcattcttactctgagctataaccctgtttatatattacatgtctttgttacatgtaagaaggaatttaaatttacaatgctggcaggagaaatggatatattaactctaaaataaaagctcttattcaacatacttaaaagtacttaaaacactactgatagtaagctgccacgaggcaatgtgtgatctacatgactctgagcaaaaatatttaaaggaggctctgatgcctatcacaaaagcacactgctgctcacaatgaaacagaagataggtatcacagccctctgagaagcatccaagtgcaagcagtaggtgtgtcctatcttaaagtgctctgatttacaaagtcagaagaaacattttgattcaaaatacaagtctctatattgtagagcaagacaaaaatactctgcaacacacctaggctgaaaataccacaaatgtaattcctaggtgatctcctttacagcaggcgcatcacatagctgacagagtaggcagggtccgggccagcctcaacaccactctctgctttagagctgggcagctggattctgttttcctggcatgctaggcctatgttctcaatctactcacttgctgaggttgcaccctgccagccttcccttagccgttctgctccctctgcccagcaccagatgtcctcctgacccctgcactctatccctaattttgcaaagaactgacctggctcctttacagccccagtgcaccctcagcaccttcccattttgcatccagcaattctattagttggacatggccatgtacttctcccagcaagccctcaaatactcacccctctccaatagcgtccagctctcatactccatctcttctgactgtccctagtccagatggagagacatacagctcttttggggtcacttcctgggctgctgggggaggctactggacttcctggatgggggctcacagtgcttagctccatggggaaactttgcccacaaaatcgtttcttatttttttcccctttcttcttcgcttccacccaccccttccctcaccccctcgcagtaactctaaactgtttactgtttttgaacaccttcattcctgcagggcttcaacagcagtgtggccaagtcagtggaggggctgctaaagctgtcttcgtgtttgtctgtgccactggggcaggggtgtaggatgaccttaagtctccaggctccctaccagccagcctggccaggctgctcctaatgaataacaaatgggccttcatgatgcattggctcaggaaaagctgtcattacaaaccattttgtttttttagcatgtggtaatgtatcatcttgcttggctggatgtcatcttcaagaaggtcaccaaaggtatgtgtgcctttgcccaagactctcctcccacccacccacatccccaccaccaccccttctttaaaggaacgaagtgtttgacacccttgtttggacctatggagccagaacatctaggtctctgcttgtggccttgctagtcagctataaacactccccgttttgtaagatggaagatctttagtacagacagaagacaaaccagggggatgacactgtgctttcaaaattgattttgaggaggaaaatgccctctgtcctaaattaaaaactcagatctcaattcagagagtagaaaaggttttttatcccaagcctcctactattcatcttcatttcacagatatttaaagcacgtattatgttgctatggacaattagccttttatccaattttacttgagagtttaactctcccacccgaaggttttaattataccctcagccccatacttaggcctcggttcctgcagctggaaatctgccccagtgatgttataaccttgttaatgtaacaaaagaggagtttacttaaaactggactgactatggatttaagccaaatttacttgaaagaggaaagagtctgtcaaaaatcctatagtaaacacggcaaagcagttctttcatagccttcccttaattcatagcgacaagcaatttacatgtaagtggattcatatgctctaccaagaggccatctctccaagctggggcgatgtgcaccccccgcctcatccgcctcctttttttcttttctgtcctcccttttagtgtttttttctcttttcttttttggtatgtagagtaggccattctccttggtgaaacagcataaatccacaatgttttgatcgccccaaagcataattagggccctctaaacatttaccaagccagtcactctgaataaaggcagctgaattttcagaaagccactctcagatctgactgttgtcctgtcaacgacgcactttattttctgctgaagcctgcttaaaaagctcgaaaaactcccctgctaatgaggtaagagttgtgagctttgagtaggaattgctgatcaaataccagagcccaagtttttctctgttgccaaaatcctgagggcttcttaccttctgttaattagattaccttttttagtccacacactaacaaaaagcatacatgagactaaacacagtatgacagcaaggaagggactgaagagagagccttctgagaagacattaaagaaaaatatcactcttaatatccctggataaacgggggtaaaagagactacacgggttatttcagtctgcaacgggggaaatccctgacattttagaagcaaaaaccaaaaaactaatttcccccaaatagaaaggtaggggtttgctgtagctacgctattttcaactgtgctcgttgacaaaacccatccatagcaaacaactggccagcactcaagtttctttcatgcattttgaaagtttaattagttctaactagatcaaaagttgcttttcccccttttggcatgtatctgtatcatttctgtgctatttggaaactgctagacatcaaaggcagatccatcattcttgaggaacctccactcctcggatgagattcagatctaccttgccttccttactacggatctcatggaagccagcgcagctggttgcaccccaagatatgcacatagctcattgtcactcctcctgaagagctcctggtgccaagtagcagaaatgctccttagaatgcccctagacaaccccaaagcaaacataacatgtggaaacatggcaaatcctccaaaacagagaacctgtgaaaaatattctaagatggagaaagtccagaacttagcatcatttaagcctttaacagcccatgatatagggacctgttttaattactctaaagttatcctaatttttttttcatttctctctctctcttttatcctttttgctattcattctaaggtcttttgttcaaaactttgaactggattagcaaattactaggcaaatcgactatgtacccaaagccttctagttaggagagcttagaggttataaaagccccaggccttgttggtagaaggccaaggttggcatctcagccctcccccacattagctgtgtgccttgggcaaatttatctagcctctctgggcctcagtttccttccctgtaacttggggagaatattctctctttcatcaggttgttccaaagaattagtaagatgtaaaacactgagccctgtactgtgttttataggccgaatatgcccataggccatgctcagccagtgttaaacatcactctaatcgaagtaaccacttctacttctagaggatagagttgcagtgttctctgctatggccttttaactacaaaagtgaggttgttttaagctccaatttttgattacatactatgtgccaagaactgagctagaagctatttaagcaaaacacacacaaacacacacacatacacatatatgtattttatgtatgtgtgtgtgtgtatatatatacatatatattcacacattttttttggtcagagtggcaagctctatgggctccaaattctagttgcttcttcatctatgcagagtctctggcatctgagagaagccatatgacccacttcaggccaacgacatagcaaaggtccttggaagggggtgtcccttcctaaatatggaaagatgtcctttcctacaggtaaggtcatttggcacttatacttcctcccgttgggacacagatgtgatggctagagctgtggcagaaattttgcaacatgaagacaaaagctggctataacaggataaactaggatggcctagtttatcctggactgcctgtctccagacttgactgttacgtgagaaaacatattattctatttgtcaggttttctgttagagcaggcaagtacattcttagctgatatctaccctgatttctctttggcctagaagaagctacagagaaaagaggatctctggacactttgcagatttacttggacctatttaagaaataattagaggccaaattgagatgtcgaattctgctgttcaaacctgtcacacttccctttccagcagacccaccacatgcagcaggatcacacaacacaatgactgaattatggttttatcattgtctgcaatattttgacttcccttgggttccaaaatattatgttttaaaatctccatacttgccgttggttgggttccaaaaagaaaagacattactggagagcctgtgccttcctaagaagcactgacaagaggacatcttgaagtgagcacattaatgggtgtcctttaaaccctccacttcccattttcccattagagcctccttaatttggcaccccaggattcacttaaattaccttcttagctgggattaggggagcaaaaggagaccacagagccctgaccctgacagttcaaactgtcagcgccaggagactgacatttttctccttgctaatcctgcactgtatggcatggtctcaattttggagaaatctgaatgctcatacacttagccaatcctcaagtgattcagatagactcagtactggataagtgaggcacttatgtatcttgaatatctctgcttgctcgacgccagggcctcaatattttgataaagcgatgacaggaaaaacacagagaacaaaaagcaaaggcaaagaaaatactataagtacatggaaaaactatgaactgctggaatttattttgtgtgttagagaaggaatatagttccctaatgcaattttcaaaatgtagattttagaggccagattggttttccttcctttttcaaggaaactgaagcagagttgggctcagaaaattcaaattcaagggccaatttctaaaagccactttgaatggttttgctccagaatgtgccaaaaaagtacaccaaaaagaactttgaaaaccttctctgtctgtagcagcactgtcaaatagaaatacagcacaaaccagattttctaatagccacatcataaaagtaaaaagaaacaggtgaaattaatattaatatttttattcaacccaaagtattaaacatgtaattaatatataaattattactgagatgctttctattcttttttcacactaagtttttgaaactgtgtgtgttttatactcatagcacatctcaattgtactagccgtatctcaaaatctcaatagccacatatggctcatggctacagtactggatagcactagtctatagtacctatcctctctgtaacacacacacacacacactcagagttaacagcataaaggttgtcattatagcaggatgatatgtagctctttttcaccccttctacccatcccatatactcagtagactgcagaagacataaatcagcagcaggtatatatatatatatatatatacacacacacatatatatatacatatatatatatatacacatatatatacacatatatatatacacatatatatatacacatatatatacacacatatatacacatatatatgtgtgtgtgtgtatatatgtatatatatgtgtgtgtgtatgtgtgtgtttatatgtatattatatatatataatagcttaatccagataaagtttttgttattcaccatttctgactctaaaatagcagtttcatatggtacaaataaatattttaacccaaagatttcaagagaggagttactgtgagattcagaactaggcatatagtggatcttccaaaaagttactgacatgagtggctgctaattgcaaagataacaaccactgtgtattttacatccatgtgcagcaattcattaactattaacacacttggttccttctttttaagccaacatgcagtttctataagtctgaccaaaagataatattttatcaaaaagcaaggcactggccaatgataggtgctcctggccaccatgtgcagcttaaggtttatggctgcaaatgcctgaaaagatataacttaaatgcctcagaagcccttcaaactcagtctttgccaaactgtcaccatcatcacaatcacagtcatcatcatcagcagtaccaccaccacagccatcatcattgggtcatcatcaccattgtcatcacatcattattactgtcattataaccatcatcacaaccatcatcatcattatcaccatcaccgccataatcattgttgtccatcaccactaccaacaccattatcaccatcattaccatatctcctgtttagtaagtccttacttagtctcttttacccacttcttcacctgttgaactattcaatctttaagacccagttaaatatcgactttaagccacccctgcaaccacgtcacaggccaaatgaatttctctctcatttcttgggaactactgaaaaagccctttgtatatatctaggttataacataatgacccaattatataatcttctctacctactttcagctcctacaactaggcctggtacttactacaagactcaaaataaatataagttgattgaattcaaatgagtgagtttcacttcaagcaccagtgcctttcacttggtaatacattccttcgatgctgagctaaaaaatgattttgaggctgtgatctgatatttccaatcattttatatatattctcctttcaaacaggctgtatataaacataggcatggactataactcgtatgtctttgcagatttcggagcactctgcagagaccccctttaataaatattcacataccatacaattcacctacaattcaccattgaactacagttcaatgagtttttgtacattcacagaattgtgaaaacatcacccacaatcaaattttaggaattttttttcaccccaaacagaaccctatacccattaccagtcacctctctcactctccttccaccagccctaggcaaccactaatccattttctgtctctatagatttgcctatttgtcatataaattagatcatacaatgtggcctttttgactggcttctttcacttagcatgatgttttcaaggttctctcatattgcagcatctatcaatacttcatttctttttattatcaagtaatagtgcattgtatggatgtaccatcttttgtctatccattcaacatcaattcatccatttgacttgttttcactttttggctattatacataatgctgctatgacccttcatgtacaagtttctgtgtgacaacatgttttcatttcttttgggtatatatctagaagttgaattgctgtgtcatatggtaactttgtttaacattttgaggaactgccaaactgttttccaaagtggccgcaccattttacagtcctactggcaaatgtatgaggtttacagtttctccacatcctcaccaacacttgtaattgcctgtcttttttctgataaccatcctagtggatgtaaagtggtatctcattgtgattttgatttatatttccctaaagactaataactttaagcatcttttcatatgcttactggtcatttgtatatcttctctacagaaatgtctattcaaatcccttgcccattataaaataaggttatttgagtttttattgtttagttataagagttcttataactcttatagaggatacatatcccttacaagccacattttgaaatatgacttgcaaatattttctcccacattgtagtttgtctcttcttgatagtatcgtttgtagcacaaaagtttttaattttgatgaagtccaatttatcacatttttctttagttatttgtgcttttggtgccatatctaaagcagctttatataacccaagttcaccaagatttatgctgatgctttattgtaggagtgttacagttttaactcttacatttaggtctatgatccatttgagttcacctttgtgcatgatgtgaaagagccctgtacatagcttagagttttaagaaatcatccattaagttttttgtgtatttcacagccacattaccaataatgtcttccttaatggcaacaatatttgagtatgctttctcttgagtattttagagagagatttagcattcaagatgtccagagaaattaatacaggaagaacctgggaaagcttcaaagcttgttcatcatcaagtcactgttaatgttggtaaaattcccccaaaattgattttacatcgtcttggatatcttttatgatataaaagatggttatataattttatataatataaaaatggttatacaatgatataattgtcttgaatgatttatatattctgaaaattgaaaattcattaggaatttatgttttgttttgttttgttttgttgctttttggtgttatttatccttccttcctccctcccttcccttccttcctgttttctttctcaacacactctcttccttccttcctaagtcccttcctttccttccttcccacctgcctttttcccttatttacttccaaatttcctttcctaattcccctctcaaatcaagtgtaagctgcctgaaaacctcctctatgtcttgatcatcttggcaggactttcccacccaccacacccacctcccacacacagtgcctagcacagggcctggcatgtggtaggtgttcaataagtgttttagggtttaactcaaatagttaagccctttccatgagttctgaatctaagctgtaagggttctagtcatccgtagtgaccatacatacacaatgccatctgtattcagtttgggtggtggagggaggggaagcatttattttacaatgactagagaataataagcattgcttcatgtagatgaaaaaaacaagagaaaaaattgtaacaaaatgcaatcgcatctatgtgaaatgtatgcatgagaaaagagactaaaggaaaacagaaataaaatgtcaagtctttttcttgagtaaactcgttcttctttttgctagtcaatatttctcataatatgtatgcataatttctatttttttaaaaagataaaactatttcaaagtaaatatcatttactcttgattttcagatattaaaagagatgtaatgtcactgctattggtcactttaaaatgtcaaataagagaaagcacttttatagctataaagttttatacaaatttttattttgtataagaattattcttatcttgaatgatataatattattcttatcttggataatcataaaacaatgattcaaccttattcagcccattatactgttaaaatacctagcactactagaatttccgatcatctagcatagataattttgcatattcatttggccctaccatgacgatagcttacctcctcctcctcctctctcctgctttcctgacgatgtgtacgtttctacatattaaagaagaatttcctggtcccttaatctttaagtgaagtaagctctacactttcaggacttattagaaagcacctaagtgggacgagtgtggtgtgtggaccatggaactgtgcacaaacacaagtgcacagtcaagtcctgcatctacaacaggcaggcttttctccagatgtggagtgagtgggccatgatataatccacatctaaaaagtgggaaaatccactggattcctgtaaactgtttgttgactggatttaggaaccctggagcctgtagttagttatcatttctgttctggtgccattgaggccgaagtgaatggtgccaagagagtttcaggagacaagggcataattcagacagctcacaagaaaaagaacaaagacatctctggtagcagaagctggctctccctccctcccggctgatttggtgaagcccctgttctgtggacttccacatcagaggctgaagccgtcctagccctctgctggctgctgctcagtaaaaacaccataccattccataattttgatcattattacttcctcagttaatgaaacttaaagcatgttttcagagatgctaaggggcagaggcccgttttggctgaggtcagccttggcaggagtcaactcttcttttcctaaggttttatattcttttttaaaatcgtattatttcaagtattgaaataagaaaacattagattatgcaatggaaagtggctcatggttgctgccacagattttcatgtatatacttttagttgtattaaaaagcttaactccaagctggagttttaaataatattttccaggctcaagatctccctgaaaaattccaagccagttctgggagcctctttcattgtatatcttatttttttctaaatccttccttattataaacatataaattattcctaataccttcatgagggaaaggtaatgccaaaaattttatatccagttacagttgaccaatgtgaatgtaaacaatgttgctacgcattttggagatagcctctctaatggcagcttgggataaatgacttgggttagtagccagctttcagtggtaacatgttaagaagaatgtgaaaatggaggaaaaagggggtctctagccctgcttggtggggaacctatttgtcttaaggcaaagataaggttaggagtcaaggatgttgtggtagaagattatctattattgcctacttacggagatgacattttggaacctcctctcctcccctcatacaaatgacagctttcagcagaaccttccagaactgttctgaacttttagcaagactccatctgtttaatcatcaaattctttttattcaccatttgaatatttttttgattatgggttccatatgaaaccattcttctgtccccccttctttacctccccaaattcttccaccacacaggtcgtagtctcagttgaaatgaccctccctcctgaaagcattcctcaaccacatgactccttcccatctggaaagccccatgatacccaggtctttggtctttccttcccagagcacttaccaccctgtattataattaccagcttatcccaccaacttccttattagagtgtgagctcgactaggcagggaccatgtcactagggccagatgcagcaccctcccagagaagatgcccagtaactatttgtggaatgcacagagaaagaatgcacaatatccaaaggagatgaatcttcaaaacccgtcacaagaagagaagggggaaccgacactttcacagagaggcgagaagattctgcagcatagagtgtattgacaagaggagaggacagaactgtcctaaacactcaagggttgtgaaaaaccgaatacatcagtggcctcaaaaagcaaatgtaaaagaaccaaagaaccaggaggtgaaatgataaagttgttatagtataaaaaagagtacaatttttttttttttgagacagggtctcactctgtcacccaggctggagtgcagtggtatgatctcagctcactgcaacctctgcctcctgggttcaagcaattctcctgcctcagcctcctgagtagctgggaccacagacgcccgtcaccacgcctggctaatttttagatttttagtagagatggggtttcatcatgttggccaggttggtctcaaactcctgacttcaagtgatcctcccgcctcagcctcccaaagtgctgggattacaggcatgagccaccatacccggcagggtagacttttcaagagacagagttctctgaagaaggaatgagttccctcaatgttaagtagatttattaagacttgctacttagcaagtcttagcaatccatgctaagtgttttacatgtaccaactcatttaatgctcagaagaatcccacaggggagggaatgtgatttacacacttggccaaggtcacagagccagcagagcaggtgtagggccaagattcaaatccaagtcatttgatcccctgaagcctggacacttaccctcgtgctaatgcaaccctcatcacccaggggtcaagcagatactaagagacccattcccagggggctaaggagcccaaggagttaaggaacaccaacggatgagattacagagcagaaacactgtttccatgacgacatttaattgtcaccactcagtcttccttggctcaaagccaactctcaacagaactgtgatggacgcaaagtctgttttggtgtgggactgtggccttcacatttctcaccccatttcagataccttctctccctagcttccattgcagccagggctagaatgctgctcaagttcctgacccagctgttacggcattttgaatcaatcctctctagagcaaacagatttgaaagtcaattcaagcccaacacaaaaatctagctcaacccagtgatatccctggttacctaattgagggatatttggatatggaaaccaccccactgaccccacaaatcaccaaagtggtgtcaaagttggatgtacaatagacattcaaataatcaatactggagtaagctcccagaaagctgggactaagccatgactggatcaacatctagtacagtgggaggtcctcagttattgctcaataaatgagagttgaattaattaatgctccagagcaagcaaccatgaagaagtgaattttttcccaataaaacaggtggttttgggggtaagccaatgtgatgcttaagaaaaacagtgcaagaagctgagtggcttatgttcagacctcaccagagattcaggtgtttaatttccctacaaagaaggcttaatctcagtttcattctctgcagaaaagctaccattaatcagcatccaagaacccttaggtgtagataatgtgaccaatgatcagttcaagttcacactctgaaagttgtttcttcaaaatccggaagaggcaccattcggccaagaagttgaaaagagacaggaatttatatgcagaaatgtcaataatcataaagagataacaaaactctaacgaagatgtaattatgtcaaccctgggacatcaagacttaagcaaaatcctcaaagaatagagccaaaatcaattaaggaatgtgtcagtggtgtaatccttctgatttccccatataataccaccaaatggtccattttgctgttttacagcaatattttttaaaaaattaaaatctaagcctttcatatttgggtgccagagggtttcaactctagggggaaaggtcttcattagaattcacctctactttaaagagtttgtaatttggtgtcaagatgtttatctgaaaaaataatgtttatactgaaatatttacagatgaaatgacataatatcttagttttgcttcaaaataatctagggatgaggcaaggaagtggggaatagaaaggaaacagactggcaatgagctgataatcgctgaaattggatggaggtcatgtgggggttcactttactttagtatataattgacattttaaaaattaacagtaatttacccaagcccattggcccaacagggaagagatggtgttcctaggaatactccactccattctacagaggcatctcctgcctttggaggaagagaaaccactactcatcaacaccagactcatggtcatacctcatttgagggcttgtgtgtttctctccacatatccgcatggatgccaggcttccatgcaggcttctcatggcaatttctaaaaaaataggatttactaggggattcttaattaaccaaaattacttaaaagtctgttctccaaatataggcatttgagaaactcagctttgcaaatgcagtttacttaacttcaatagaaaagccttctcaacaaatgaaagcctgcaaaggaaagcttcgtagctatttaggaaatagttctccagaaatttgagaggcaatgcccagacatgacagtagattataaaaggttcatattggaatcagttgcatagaactgaaaaggtttatgtccccagagaaaagaaaacggctctgattgatggccaagtgtccaggatataccaccaaaggctgaatagtggaaaacgctcctctctaagctttctgaatctacctggtctgggcccctctgcctccagaggtgctgggcatgagccagtgttaaaactctactagtgccactaatacaccggctcaaggtccatatttcaggaaagagctgggccacaggtccaaggtgagaaacaacagacagatacaggctaggactagaccagctgttctcaaacaggggtgattttgccctctagaaaacttctggtggtaatgtctggagtcatttctgattgtcacaactgggggagggaaattgacactgtcatctaatgagcagaggccaggaatgctactaaacacaggataggccccacaagaaagaattatccagctcaatctcaacagggctgccctgagaaaccctggactagagcaacatttgccaaaataattcccccacagctctcctgcatggaatgatggaagtgttgatgggagccaatgcagagtgggcaggaagaaaggaaaaagagggtcatgcttctagtgtgcccacatccaaatgtattctcctcacaaaagccagaggcagggtggtgccattgttaaacacatggccaaaccacaggacaatcctgagaggttcaaatcccacctttgctgtatgacctgggactagttacttaacctctctgagcctctgttgcccgaaatgtaaaatagagatgataacagtacttatcttggaaggttgttgtgaagattaaatgaattgatatatataaagatctttacactgtagttatttgttatgattttcaaaacacaatccagtcatgtcatttccattcaatgagtttctgctttaggataaacatgaataatctgatgatggccccaaggccctgggtggtctggcctctgcccacctctccagcctcaaccaatctagttttcccctttgatctctatgctccagtcacacaggcctccactgagcaaacagaaggcaagtcagtccttctgccacagggcctttgcataggcagatcctctcttatggacaaactccccttgaccccacccaccatccccaccccttcacctaatgtagctcccagacacatctcagggtgccttcaggaagcatgggtccagggacctctcctctttcatacacttacccagctgtcattctgcattctgatgtctcatcctttgactggacattagactgttaactaggtagtcaataaataaatatttgtttattctctcaagaaataactgacttcccagcatgatttgttttatgaatgagtcagtgactaaacaaatgactgaatccatgagaaggagcgcttagcttgcctgacctcagtctagtgtgttgcattagagcagttgcaacaaaaagctgcaattgccttcagcttcctggaaaccaaaaatgctctgagcttgcctcaaagaatgctacccataccttggaggcagttgacttgtacttggccagggactcctagaatgttctctttgcttctgtctcaagaaactcagtcaaaccaactttctctaggctgaagaataaggcggggaggcttttctttgtacatggaaggagtatgggggtgttttcacttgacccaaaactgagactggctctggcaactccagccccacatctttctaaggtaggagcagcagcagtcattcatgttgaagggtcatttgaaagccattcttctttacaaaaccacagaatggtggttttgttttggtgctttgactttagtatcaatcagcttattttcctggaattacttaatatgagaaatgtaaacattttctagcaacatattctaacacttgttagaatgatttaacaatgatttgttaagtcattctaacaaatcttatgtatctgaccgcggcaccatggccttccccactgtactggtctgagtcctgaagagaacagaattcgccacagatgattccaatgaggagacttccatggagaagctacagaagtaggggtgggcagggttaatgaaagaaatgagaccttgaggcatccagacgctagcaacactggacagccgttaccacgtatcaggctgaaggagcaaagggagaaatgaatcaatcccagcgacactgggagccatgaatgggcactgctgagagggagctacagtcatggagagaagctgctatggccagagatgtggccccaaagcaagaagggaagagggagaaaatcctctagatttttttctcttccacctctcccatcacctgaagtgcctcttactggccccagaccctccccagagtcagccagcaagggatccccagtgatgctgctcacagcagtcagcttccaggaaaaatgaccaggagaggggaagcagagaataaccactgggcctacccaatcccacactgccttataataaagcattagttgacaggagccttgaaaatacattgaagggaacattttccaagaaaacttccagaggcagagccaggaagagaaagaagctccaagctcagggctcagtgaactgaacacaaaaacaccaatttcaaaatagagtggaatgacagcaattgaactgttatcataactgcatgctggcactggctgcagtgcactctgcaaatgtcttcaagtaagtgaagcatcaggggtgaggtaatagcagactctcagagttggcctcagcttcctgcaggttcgaattaagatcccagggaactggcttaaccaaaagatcaagtcaaacactgcatttcaattttcacaatctgttggttcccaaattccgtgactggaacacaaaagacttgtcccacttgactggcagcttggctttgagctatagttctcgatcgctttgctcctgggaactgagtggtcccccttaacacacctcattccccaggcaaaattgccagagccagaccctctttttctgcccctaaactcattcacacacacacacacacacacacacacacacacactctctctctctcacccctcttcccacatgtttggtctactttggtctgcctcctgcccaaaagtcaaaattacaatctagcaagataaccatgctgagacaatgcagaaagcattttgaacccctgtgcttttcaaggcaccagaacagggataggaaagggggaaaaaagacaaagaggagagagaaggatggggaaaagttaagagaagaaggaagagaggaaggaaaagaagaaacaggacatggagtggaagagaagagagagtgggtaagaaagggggaaagaaaaaagaggcagccagcaagaagcaaagtataattttcatcaacattcattcattcatttgacaaacatttattgaatgtttaggagggaccaagaacattcaaagcccacctccatgctattcctcccttaaaatcctctgagtcttcattgacatggatccttttgaaatagctcgttccagtgaggacatagatcttgaggtttaccttttcatccttagggttgagacttcacttgataatatttggactggattttaccaaggcaaagaaaatgttacaggaaggcagagaaaccctatgaattgggatttgcccaagacctgcccttcatggttgaggcaggcatctggcatccaggcagcagtttgtttcccttggatgcccacaggccctgcgctgtgttctcacttcaccagtgttctcatttctcttctatcctttctggtctaaatgaacattgtaagaagtgcttccctagaaaaagatctggctacccagagggatgttgtgaagaaggaacaaatggtaaggagaaacaaaagtggaaagagagtaaaaggggctgttataattgtgcatcaatttacaggaccagcccaacccttgaggactgtccaatttcacactctcaatttatagctgggcacactgtggaccagaaagaaccacaggttaaagaatgatggaattctggagctagacaggattatgttgtctgccaagcagcaggcattgatggaacaggtcttttggattccagccagggtttacatctcacagggagttccatcccctgaggatttgaatctgagaactgtgtcaattccactggggagctacatagtgagctggtctttaatgccaagaaagcaagctagaatcaagaggtcaaagtcatctatacagaatgggaagtccccaggccactacaacctctatgcctgatcattgtgctgaacaggaaaatatatcctgtgtgagttccatgtgaaaataagtcaagttaaatcagagatgagaccctacaaagctcttctctcttccctagtttaagaaacaccagtataaaaaatgaggctagttacaggttcctcaacctcagtaccactggtattttgggccagaaaattctttgttgttggggctgccttatgtgtcataggatatttagcagcctcctggcctctacctactggatggcagtggcacctcccctccagttgggatgaccaaaaatgtctccagaccttgccaaaggttcccctgataggtaaaaccacccccaattaaggcctcagagaatcactgaatattaatgaaatcatctgagtccacaggcctgttcacagatggaaagaccaggtcaggcgtgcctgggcttaaccaactacaactggcagagtcaggctatgaactagagtgctcagggttctcctcactgcaccgataattctttttcttttctttcttttctctttttttaatttttattttttcttttttttttttttgagacagggtctcactctgtcactcaggcaggagtgcagtgatgcaatcacagttcactgcagcctcaacctcccaggctcaagagatcctcccatctcagcctcccgagtagctgggaccacaggtacacaacaccatgcctggctaactttttgtattttttgtagagacagggttttgccatattgcccatgctggtctcgaactcctgagcccaagtgatccactggcctcagcctcccaaagtgctgagattacataaataattcttccttcaggatttgatgtgtgattcctctgtactctcggctccttagtgtttctttgtgtgatgtggctgccctgtcccttgcatcaaggggttaaatctggcaacgccccctacagtattagatcaggtactggtcagaattctttcaatatgttgctgctcttggattggaagaaagggccaagactgcctcctctgacttaccatgttttaggaggttggaaggcctgaatatttcttttcccttttcttaatgggtgaccttccctagcccccatgcggctgctgtgaagatagagataacatgaagtatggtgcttggaattatttaaactctatgattcacaagcatttagattatttaactgctgattatgattatttaggctgaaagactatacttctctagctcagaaaatgtttgtatttccattaaaaaccaccaggctgaagtcccttttgactgacatttttctctattaaaactatacatacagtgcatgtttttggccggaagacagtgtgtcccttattttgttttaagataaggaagccaacttcaaaggccttctccaactagttctcctcaggcccccttcctcccaccatctccccatcctgctgtcctcctgccccaaaaaagggaagaagcacctatctgcccactgctttctactatttaattaaaactggtgccaccattcccacacttgaaattcttacactgatatctcaagttcttcattggaagactgcactcaatggctaagactgtgaactatagtgtcaaacagacttgtatttgagttccacatatatgagcctcagtgtctccatccacagaatgggggcaataatactccccgcctcacaggaggtgacagcactatctgggtgaagtacttagtccatggaatcagtacttaataagtgttcactggtaatattaatcccatcccccaaagtctgcatgcactggatagcatatatgcctgggctaatttaattctctgaagacattttaatccaagatagtacattcctcaaggcagggatagtgaaggactcttgattctacctgacatgcaatttaactcactttaattatttctctataatgagctatgaaacacatccctgcttggctcatatatttaataacctaagagttttatgaaaaataaatgcctaaaaattcagggaaaattctattgtggatgtattagagcagtgtcctaaaccatgcagtaactttcttttttctttctttttcttttctttttttttctttttcttaatttttttttttggcagagtttctgcattcaaattaagtccctcaagggaaggaacgaaaaagagcccagcatttcctaagtttcatctacgtgacagggcatttatttagtggaattacatacaggagggtcttggagattgcctttgcctttcacttgggatgaaaatttcctctgcagcatgcaaaacaggtgagagtgttcctgctgctacagagttcttttgcactaaaagaaaaatcttcctcctctcaaattttgcctaccaactctagcacagtcatctgaggcagcatgaatcaagcccagttttcttcttacagtcacttccttaacagttaaaagaagcatctgtcttcttggacttctctggacctaataccccttataggtcagctatccccagcacaaagagattttcaggaatacctcaacttgttcactcactacatgcctcctcacagtctaccaaccatggtacccagaaatgaactcagatatgcactaaacatacatgcatacacatacatgtctgttaggaatagactagaggtgtaattgcaaagttgttttttactgctaagtgacataacataccagttgacctatttttcttcacactttattcatgttgtcagagactgccaattgcccccaatatccattctttcctttccttccttagaactggattcccagaatgcagctaaaggctatatttccctgcttggtcttgaagctaagtatgaccatgtggcttaaaaccctggccagtgggccccttcccccacacttgttctcacatctagtaaaatataagctccaccaacaggaggatttttgttcatagagtcctttctgttcactaagaacagggcttagataactgcctagggcttagaacagtgcttgcacatagcagatgctcagcaaatattgaataaactgtgaaatgactcagatgtcaatggatgggatgtgtaacttaaaggacagggaggtttctttctcgtgcctcctttctgctggttggaatagggattggatagctggaactgaagcaaaagtctcacactaagaggtgcaagcaaatgctaaaaatggcaaaatgtcaagacagaaggaacgtgagtccctagtgattacaaagctacttgtatgagcttctggaatgtggggttttctgattcttgcatttgaagctaactagaacattcctctattctaaagttattttctttatagttaagttttacttacccactataagttttatgttcagcatagtttttttgttgttttgttttgtttttgctatagactataagccatcaacttcagagttaaaagaaggaaacagaaatctggagtagtaagcaactgtgcatttatgtcactgcctgcagctaaaaccaaaattggttttgaatgagtcattttttgtgacatttattccttccctctctgctacctgtcctgactcactacaggtaactcagaaagctgcaataggctttatcagtgttctagctgatttaaatacctgttggaactgagcaggtagtaaacagaaacagatgacaaacaggacattctaggacacattaccatagtatttaatatttttaaaattggacatgttaaagtttttctcaataaactactggttaaagaaagaatagtattatagcaaaaaaaaaaaagaaaaaaaagaaattcttgaatggagaaggccaagttgtaaattaaagacaggattagtgtatgctaactgtaatgaatgtacctaacatactaatatatgtatagccttttgtgggttaaaaatcactttctcatgaatttataatctcagtcaatccccataagatctctgtgggctagcacaaccctcttgtttattgagtttatcaattttaagtaacaattggcttcaaaactcttctcccaaactccatttatcctgtccaaattgctaggcacttaggattccttcctaaagaaatgtgatttgtcttttctcatgttggcatgaagtaaaaaataaattgattttatcatttctgcacccttgctctcctttgaagggtacttacctaatgagtggctctctcagaaaggatcttagatcaaagaggccaacaggataatgccctcgaataagctgctgtcttacctcactgtaaatgtcctaaaataatccagtgtatacaaagacttgtgaggctatctggagaagacgtctaaaacccaacaatacccagtaaattaagatgaattgcaccatatcgtcagatgagttaaaaacaaaggggcctgctgaaaatgtttgtataagcataggaaatcaccacagaaagtctaaaataaacatttcaaaatatgtgactattaagcaggtatcaaaacccttattcaacttagcattttatactaaatgaaaaatatcaattaggatgcctgtctacctattaaactactatagtagtttaaatcgtcaaagcaaatgcacacagatttttaagtactgtatctcatggccctcaatttcttttagccacagatttcaactccacctgccataaattaaataactgggcttttgttactggaatgtaagcttattagctggcattaataaaatcaaacataaaatgatgttcttaatatgcttttaataaaattcctttaaaataggagtaaatgtaacaaaattgaacaattatgaaatgttttagcaagaagttttggatatattttaagtacaagaataatcttatacacaaggaaaggtgaatattatgtactatgaaaatatatggttggtaactgttagtttcttccagcagaggaataataactggcagttagaatatcaaccaataaagaccagactgaagaagggtattgctgtggtttgaatatttgtcccctccaaaactcctattgaaatttgatcccaggtggggcctaatgggaaaacggtgtttgggttgtggggtgaatcccttgaatagattaatgccctctcccttgggggtgagtgagttctcactctgctagtttccctgaaagagctgattgttaaaaagagcatggctctttccctcatctccaccttgcttcctctctccccatgtgatctctgcacatacagctttcctttcccttctgccgtaagtggaagcagcctgaggccctcaccagaagcagatgctggcaccaagctccttgtacagcctgcagaaccatgagccaaatgaaccatttttctttataaattacctagcttcagtattcctttatagcaacactaaatggactaagccaggaatgttgagggaaataatcatacacatgtatacaattggacttctgtatacataggttccacatttgtggattcaatcaaccacggatcagaaatatttttggaaaaaatgcatttgcactgaacatgtacagactttttttcttgctattatttcctaaacaatacaaatgtaacaactattttcatagcatctacattgtattaggtataagaaggcaggagatgatttaaagcatacaggaggatgtgcgtgggttatatgcaaatactatgccattttatatcagggacttcagcatctgtggattttggtatctaaaggaggccctagaaccaatcacccacagataccaagggatgactatagaatcaaggctctccttttgaatcaagttggcctcagttcctaaaagtgttcccacattacaggaaaatacaccacactttccatgtccctccatgccccaaataaacaagagggtccttacctttggaaatgactttctaagtgggattccaaacctctttggttacataagaaactactttatctatttatctattcatttatttgcttatttgtttattcatttccttcactcattttactaaaatgcaagctcaacaaggtcaagtttgttcatctaaaagagtacctagcacatagtagatcatcagtgaatatttatacattttttaactaattcatcctttcatttttcaaatactttttgagtgcctaccatgtgacagattcacaatatccaatattaaaagaaaattccactgtaaataaaatcacatcgtgagaaatctttacattggaagaatcaggcaatatttactcactctaaatccagttggcatttaaaataagagaagccaaagaagaatggtaggagaaaatgtaggtcagtgtggcacatgtcccaaaatgatataacacaaaacagaactttgggtaaaaattaaacagcctaagagtggatgtaagtataaaaggatagtaccagaggtcattgtgatgattaaacagttctgcatcttgactgtggtggtggtgacacaaatcagcacatgtaataaaagtggatataattaaacatacacacacacacacacacacacacacacacaagtgcatgtaaaactggataaattggaataatgttaaggccgggtgcagtggctcacacctgtaagcccagcactttgggaggctgaggcgggtggatcacgaggtcaggagatcgagaccatcctggctaacaaggtgaaaccctgtctctactaaaaatacaaaaattagctgggtgtggtggtgggtgcctgtagtcccagcagctcgggaggtggaggcaggagaatggtgtgaacccaggaggcagagcttgcagtgagccaagattgcaccactgcactccagcctgggcaacagagtgaggctccgtctcaaaacaacaacaacaacaacaacaacaacaacaacaacaacaccacaaaactggagaaattggaataatgttaatagatatgtaaaactggagaaatttgaagaaggctggtagattgtaccaatatcaatttcctcatgtgatgttgtactttagttatgaaagatgttaccaattagggaaatggttgaaggatatgagaaccctctttataatatttcttgcagcagcctgacaatccacaggtatttacaaatatgttaataaaataaaattaaacagcagaatgcttatcagaacactggaactgacacagatgcccaataatgatgtaaacctatatgacagtatattgagtaattaaaaataatgcaatcctatgtttgcaacatagaaggttgttcacgttcacagaagaagaggcacttgcaaaataggcaagtacagtccaattttctttacaaaataaggagcatttgcaaagatatacaccaaaatgccatcagtgtctctctctccatgttaggatcatgaataatttttttcatattgtttctttatactgcctcttttttttcccttaaaatgaacaatatcacctaacaaacatctaaacaaatatctatctttggatggggttcaggtaaattctgtatagctctggaacaaaaaccaagacaaatggaaagacatttcagttcaatataatgacaaatgagctacctgtaagagccatggaacatgaaccaccaccttatgagcccatggcctgccatgggaatggtattcaccagggcctggtgaattccttatgagtaatcctgtgaatgggagacaggcttctgcaggctgagaggttggacccagttgctttccaattctaaaactctgtgccatttggtttgcaaggaatttaacagataccacctctcctttcaaaagccccctttaggtttcaaagcactttcacatgtgctggtttatattaattttagtttgctgcttaaaaaaaaaaatcttatccctacaagagttctgtagagtaagcagggcaggtattatcacctccattttactgaagagaaaactgaggcaaccagagagtgatgtttaatgttatggggtgagacagaaattagttatgaaatcacagtttctttctcttgactcacggcctcacccctcttccctctaacatcacacagcctctcccttcccaccagggtttggaaactgggtagacctgacctaaagatgcctgtctaaagataatgggtgctggttgaatgaaaaaccaacaatgcttggcacagatgatatcaactcaccaacaatgataatacccatctgactgttcccacgaacttatgtggactcaatcaaagtcaagtaaccagtgtgtcaattcagcttaaacactgtgactgaacaaaccagtggcaaacttgaacagcccaagaggctggtgcctctagttgaggatctcagtcaatatacttgccctgtacctaagtcctcccatagtcccagggcagaagcccacaggttgggcttctaggccagttaaatagtgaatagggcccatatcaggcttaatgaagcagggctttgttactttcaccaaaggaattaacacaggaattttgtatttattttgcagtggcagcagattaagcacttcagcaataatgtggcaattcaccaaaagaggtcttagttaggtgctatctgaaaccatgaagttaagtgggaaaacatacacatggaaaaagtttatatgttttagaaaaataaatccaaattttagataaatgatactcttcacaaagtatgctaaacagaggacatattttcattggctgatagtgccatttgcatacatatatcattttctgtgtgccaaactctctgctgagaacccctcctcacaaccacccccattcaagtcattacaggaggaaactggaaggttagtgaggttaagggcatttctcccaagtcacagccaccaggtggaagcaacaggattccaccctgggtctgatgactcacaaaccagcatatttcaccattacttgttctctcaaaatgttgaaagtatacgctccttttataaacaggaagtaattaaaatttctttataatagcataataaatcacttcaggagatggagagttaacttgagaacagctggaaaacaaggagaaaaactaggctggacttgacacataacacacagggaggaagacgagagacaggtgaacaggaaagaatacaggctgattgaatcaatggacccatattgctaatgcactaatactagtattggctattgttgataaattatttttattctatactacatttattatggaaagtaaaatgcaaaaaacatcatatgataaatttttcaagggtaaaacaaacttataagttgaatttcagtatttttaatctccattcaaaaatcaaatccaaaatgaaggtggaagcatatgcaattccaaaatctttctctattcttatataaatcataacattccatattgttttctaggaaatgaattttattggtcaatatcagcaagatggaaactttctcaaataaaccattttatgaactttgtatatagacattataaaaatacataactttagattctaacatgaatacattcataaatggactttccactttgaatattgctgtttcttcaattatttaatactacactatatttttggtgtttctcagctaagtgtttacacatatattgacatttataatttttctgggtgtcatttaaattcatacacatattccacaactaattacataagttaatcttttaaacaacagtaaatattggcaaacatcaagattttatatatgctgtgcttataaacatgtatccttttaacagtgttaataaattattgatgaaggtgataatatcgcagatacttaaaatacttttcttcttagctacataaaattcagtctccagtattcaatctagtcactcactcaacaaaccattgagcacctatcacattcaagacactgttgtgggcaacaaacaatcattgagcacctcccatgtgcccagcactgctcttgtctgcataatgactacagtgactcaaacagacaaaagttctagtcttaatgagttcacataaactcctggagaaaattagatagcagaaacggaggttgaggtagaaaactggttttgtcatggccagatggccttaagcaaattatgaatctctctgagtctcagctccctcacctctgaactgagtataataatacctggttttattatattatcttttattagaaaaaatgctagtttatatgtgaaaaaaaccctatttattctttggtcttggagaaactgaggtagttgatgaggaataaatgttttgtcctcattattaaatccttcaaaatatttcattccaatattttccatgatctaagctttctgagtttaatgctaaccatgtgtaaggcttgctgggtcacgataaggtcacttccatacctagccaccaatttcaaagtctgtgttataggcttaagatgccgtaattatgtatgtttccccttactgtggagggaagttagatttaaattataatttagtgatgatttcatttaaaaacatagagacgctccttcttgactagttcttcacaaacagacctattgcaattgatatttattaaaatttctcagtaattttctttcctatgttattccatgatgatgctctttcattgtgagaatgaaacaagagtgaggtgtaggtgggtgtgtcacaggaccacaggaacaaccatttcccagcactcagccccatgtcattgattaaatcaaaggaagcaattggttccaatccaatctccctgatttagcttcccaagcccccacctaggtggggtgtggcggggtgtgggatttctaacctatttttataagcccagcaaatcaaagtttcactttctgaacaaagaggtgccaaccttgagactctgtgagagtcaacacaaaccaggcattgtgcacaagtgagaagaatataattagcaaagttacagtcacaattaggaaataactcctcagaaaagtttccacttaactctgagcagcgctcaaattaccattgtgcttaacggggcctccatctcttggctggctcagacctttccaacagatctatgaatcccagcaccatccacacaacacagacacccaaaatctagtgctggatctatatttttttcaataacagatgtgagaaatgtgcaaattgagacaccaaagttacaattaaaaaataagaaacatactttcagaaatgaccaggcaagtgtgagctaaattattctttttctgagctctttcttcatcttctctagcccttcccctttcccactctcaagagaggctagaagagagaggctaccaaagcagcaatgggtactcacttcatctccaggatctcctccagctgtttcctcctctcaatccggaggttggccaagtgcgcttctttttcggccagggactgttgtgtggaggcgaggcgtgctttggtggcatccagttcctgtctggtcttctccagtgcattcatcagttcctctatctgaaaggcacatggagctctgtgtgttatttctccttcattcaagcacaagacatcccttgttagcctgtgttccaacaacaaacacaaaggaatcacagggatccttgaactgggccgctgtgtcttggagccctttctttctttgtcattgaaactatgaaaatgcaaatgcctaagaatgatataatggactctggggagttgtggggaaaggctgggagggggttgagggataaaagactacacattgggttgagtgtatactactcgggtgatggttgcaccaaaatctcacaaatcaccactaaagagcttactcatgtaaccaaatatcacctgttcccccaaaacctatggaaagaaaaaattaaaacaaaacagaacaaaaacccttaaaaaatgtttcaaacacaagaaatgtccaaatttctccaaggtccttgttcaattggattgcccaataacctttataaaactacttaatgtgttcactagaattgggggtgagtggcttgacccaatttcaacctctgtttggcaaaagtctcagatactttctcaccattgaaggaaggcaacactcaaatgcattttgcccagcacaatatacttttgtgtgtaggccccagagtactttgaaagaaagttaatctatgtgtttcagattcagtcacgttttaacctatcaaagccgtgtttggtaaaagctattcaatgtccagggagcctcaggagtccctctcacctcacctcccagctttacattcaggaagcaaggtttggccaaaggtaaacagaattccagccacaaaaggttcaagtttggtttgcccctgaagtttgagagggttctaaacttgaaataaatgacatgtaacttttatagggtgctaatacaccatagaaataagccagactatcaaatatccacggttttcagccaggtcccaaaaaatgagacccaggagccctgaggcaaagccttatcctccccaaagctttggggactcttaaaagccaacacacaacaaagaaggctggtgtttatggttccgttccaaagacttccgtggagcaagctggtgaaatgccatcccttgcacagatgcaggctgtgtcctccctgctgatccaaaatcatgattccaggaagtttctagattccagagctgatgtttggctttctaaaataccccttccagctgaacttggcagaataggctcatccatcactaaagtcaacagaacgcccttcaaaatgtgtcaatgacatgttaagttccaattcataaagactttctacacaatttcttcagttttacatgaaatttattcagaataagcattatagttcacatccaaggtaaattatatgcttttaagattcagaaaacccttcattttgccctgataaaaagaggaaactgaatgatcatgtagtttaaatcaaagccaaaaccaaaaagagtttaaaaagcaaggaatataaagaataacctatgaaagtgacaaaaccacccctatgtaactgtagagtaaattgaattattctttaactttacaaatctatgcagtttaaaaagtattaataaacttttcagtttctcatataagttcacagaacatcacaaatatgactagaagcccaaagcaatatgtgacgaagttaaagcggagttttgagttttcctccctttttctatttttgatagaaaatagcagtgacccccaaaaaatcagaattatgatcattccatatgccaattcagatagtctgcctgaccctccatatgagatggtctgtgtcctcatgattccttttctgtcataaatcgttctttatttcaaacataatattgatttcagaggagtgggaggtctccattattctcatttgttcaatctctctctcattcatcgaagctgatctatctgcaatctatagacacagagctactcagctgggtttccaaatcttagatcacctgccactggaccgcttagggcaaacactagctagttctacattaacccaactttaaatgacactttagagtaatgatttcaggctgctccagccatttcagcaagaagcacatggagaaactgggcacctgggagacacaatacagagttgtaactgatggagaagccactggcctccaacatcagtaactgctagtatcagatgagacgaaactgctcctctcaacatcttggagacagagttttaaaataagttcccaggccaagctcctcactcttcctaatttgtgtggccctggaccgaggaccatgtggggcactggcctcagaacacatccttctagttttagcatgaccactgcttctctctgtaactttttgcaaacaatcactataccctcggaatctcagtttcctagatgatggccatgggttcttcctgtgtttaacattctagagaactgaaaactgtttcctttgctgccaaaacaagggccttagaaagcaaaaaatatctcccctgctggggtgatcattagggtggtttcacaatattctagttctcttccttacaggcacatggtaggaccccacatcccctcaccctttgaattgggtgtggctttggccaattaaaaccactgtcatttccaggtagaaacatttaagtggtagcattcaactccagtgttaccctttccctgccctggtgaccgtggaagcaagtttcagatgacatcatcttcagcctgagtccctgagtgaccacaatgaagcccagggcaaacccacatcacataggcaaaatataaacctttgttgtgctttgcctctgagattgggggtggtaactcccagcataacctggcctatcttcactggtgaactgtctggttctattttttttttttttttttttttttttttgagctggagtctcgctctgtcaccaggctaaagtgcagtggcgtgatcttggctcactgcaatctctgcctcccgggttcaagtgattctcctgcctcagcctcctgagtagctgggattatagatgcatgccaccacgcccagctaatttttgtatttttagtagagacggggtttcaccatgttggccaggatggtctgagtctcctgacctcatgatccacccgccttggcctcccaaagtgctgggattacaggcatgagccaactgtctgattcttatcaagtgctctatgcttgcctccatctccccatcacagtcatctctcaaccagaggaaagtgcttgttattcttgcggtcccatggtatttctactcttgcagaccacaagtaactcccttcttgccaaatgtcttttcttaatgtgtggtttgcacagctaaacatgcccccaagtctctgtcccttctttgaaataacattttaactgattgactgtacatatgtagtttgtgtcttcatcaccagattggaaccatggcattattacggtgtgagtgagatgagctccttcatctttctcagcttccatttcctcatccatatttacctcaacaggtaaatagggaaccctattgcttgcttatcagatgattatgggcacattaagtgagatgatgtagcccataaggcatttattcttcttcttctgatatcaagaaattaatttttttctgataataagaataaagtgtggccagggacagtggctcacacctataatcccaacactttgggaggccagggccagtggatcatttgatcacaaatggtgaccccaggagtttgagaccaggctgggcaacatggcaaaactgcatccctacaaaaagtagaaaagaaatgtagccaggcgtggtgacacgcacctagagtcccagctaccctggggggctgaggcaaggagatcacctgagcctgggaagccaaaactgtaatgagctgtgattatgccactgcactccaggctgggtgacagagtgagaccctgtctcaaagaaaagaaaaagaataaagtatattcattgtaaaaaatatgaaaaatccaggtatgaaaatgttttagctttcttctgaagattaaatactaacatcatttttagttaagatcctcccaagtcccaccacctagaagtaaacattataaacattgttataatttctctctatatttatgcacatataattgagatgctacatataaatatatacataattgtgtatataattgatatatgatgagaattttcttttgtaattaaattgtcttttggaaatacagttttaatatatgagcagtgctctatccactcctcatcttcctaaaactgatgcttctcttagtgttatggtctcaatgtttacgtacccccacaattcatatgttgaaatcttaacccccaagatgatggcattaaggggtgagacctttgggaaatgattaggtcatgggcgcagaggcctcctatatgggattagtgaccttatgaaagaagcccaatggagtctgtatgtcccctttcaccatgtagggacacggcaagacgtcagcagtttgcaacccaggagagggccctcaccagaatctgaccatgctggcaccttggtcttagacttcccagcctccagaatgtgagaaatacatttctgttatgtataagccacctactgtatggtattttgttagagcagcccaaatggactacgacacttaggaacttattcccctgtttattttgcaaattactcatcttcctgcagcccataactgggtctttctccttgtgactccatcctagaggcatttccaccatccacatagaaatacaggggatgcattgaggtctgtctctacagttctcacctctatgtagatgtctctccaaactttatctcctttttcctcacttgacctctttcacatgtacctaaccacctgttgatcacttccatctggatgtcctaatattactttaaattgaggatgaccaaaagccaactcttgacccgtgtacacctgcctaaaccaaactcctatcacctgtcctcaccctcccaacttgccactccctaacacatccaccattttggtccaaggccctgaccttttctcagtcattcctgtttaagacctcagagccacattgatcttctctttcctcttttattttccattcatcaccaactcctagagctctattttggaaatatttcttggatccatcattcccttctatcattacttttgacacccctcccacatgtataataaggtagaacataattatgcatgcatacacatatgtatgtatatgtgggctttcacatgtgtgtgcatatgctcatgtgtgtatccctagcctctgactctactcttacccctaagtgaggacatggttttgcctgatcatctgtaacaatagtacttatagtattatatgaagcaatgattgcagagctcttagtgctgagcctggcaaatatgaaaacacttagtatattcttaacacaagaggcggagcagcgtagtggcttagaaacataattcaggagctagactgccacttactagatgtataaattcactctaagtgaattataacttttttcccaggtggaaaaattgatttcatgtaagaaaaataaaatagtatttacatttaataaataatattcaataagcactattacaaagttatagaaataaactggactgtttaccttcatgaaagaacctagacaaaattttctaggtttctcaacttaaacttggaggcaaaatttgctttaaacatgtattaagcattaccattgctatgcaaaaattaggttatggtaatttttactcaaattatattaaaatgcccagaagaaggattatttggggacaatataataatagaattgacttttttaaaaaatgttagctttaggggctacatatgcatgtttgttacataggtacgttgcatgtgggaattgggcttctacgtgtacccatcacccaaatattgaacattatacccaacaggtacttcttcaaacttcatcccccttcttccctccctactttataaaaaaagaaggaaatcatgtcctttgcagcaacatggatggagctggaggccattatcctacacgaactaactcagaaggagaaaatcaagtatcacatgttctcacatgtacgtggcagctgaacaatgaattacaaaattctgagcttcaagtacctcttgtgaagtggagctaatgacataacttagctcaaagggtttttatgatgattaaatgggttcacatgggcaatgctctcagcacaatgcctagtactcagtagtgccacagaagtatcaactctttctaatacagtgcctagtaattattcagcctatctatgtctgcatattgctccattcaccaatgctcaaccacacatacacatgcacatatacccctggactgccctacattcactcctctgcttatcaaaactgcccattctttaaggccctgtctacacctgacctccttcacagcttgcagcgatcaaaagctggagctctagaagcagtcagatatgagtcaagtttgggttccacctacaagatctttgaccttaggccaatcttaacccaatgtttcccaaacttggtttaagattggttaggttactgcatgttagaatcccttgggaagcttttaaaaatgttgatgccgtggtcacactgctcctaattaaatcaaaatatttgagggcgggagccaggcatctgtattttattaaagatccaggtgattccaaaatgcagccaagtcttggaaccctagacgttactgacctctctaagcctacagatcctcccctttaaagtggagaggaagcagaagcagccacacagaattgacataagcgtaaagtgaaataatgcatggaaagtaccctgcctaataccctggaaggcaccagcacatgcccattcctagcctcactactttcacccaacccaactgccttcagttttcattgcctgcacccattctgcacaatatgtatgcttagttgctataatacaactggactgtaatccctggagggcagagactgtgtctccatcttctttgcaagccccttcagtacctgacatagcaccagtatccacactcaataaatacctatgcaatgggaggaaggggagcacaaagacgtgattctgaaacaccctcctttgacccacttagtgcaatgatggatgaagtgtaagtccaaacttgatactttcctaccccataaatcagtggtcccttcgccatcctcaacaaatacccttcaagttcttgctctctgtttgcttcaagcaccttctctttgctatggggatgagggggctcagttacttggctcctgaaaggatggaggccctatgttcgctgccaccccagcagccgcctggagaacccaggaacctgtgagtttcacagagacacaataaagatgtctcaggttctgcgctggtatagaagcatgtggcttttggtcctgctatgcattccacatgctctgtcctgggacctgggagatacacactcctttccttcattccaccacctcgctaggcatctcccacatgccaggcactctgctggacactagccacaggtctgtcttcagaagggtttccacagggaagttgggaatcaacaaattacttaatcacaatagtgattttaaagaaaagtactgggtggtgcaaaagagtaaaacagcagcccatcctgcactaggcactgtggctggcctccctaaggcaagcaagtggagtagcctggggaagcgcaggtggtggcccagctggaagatgccctgtggtcccattctttagaaaaatgctagttggagaatcacagtaattaagagacaataaaagcttttgacagtccagcaagaaagcaacccatttgtctctatttaacacagcatgtgcttcttttagaagtacatctattagtaattcaccagacaataatatttcctggggaaaaaagttttagaaaaggtgtttaattgctaaaatgtcattttcagtgaaaacaggattcacagccacctcagaagtctctagaatattccagatgtttcacttaaaataatttcctaaaaggtcctcaaatgtggcaagactggaattctgattttatatcaaagattacatttttaaaatacattggcttggtgttacatatctagaacataataattaaaggtttcttcaagctagatgttgatttagcttaatcaattacaaaaaaagaaaaaaccctgaataattgtgtgctatttctgattgtattagtcattctatgttgcagatcatatcattaaaactctcttttaaaatagttgttaccaggaaatattcaactgtatttactgtatctgaataattcataactgttcactttcagaataatgaagtcatcacctggctttctaaaaagtccagtgtttacgcatggctctggagaaatcgtcggatcttttaaagtgaacagtggagccttaaaacaataaaataaaaaacccgtttaagaccttaaatcattaacatgtgtcgacttaaacttacacatacatttgtgttgtttaactaaatatttgaaaaccagcctctctctcagttatctgccaggaccccactccaggttccatgcatctcttcctgacgcgtggcagcttcccatgcttttcaagaggcttgcttggcaagagctgatactcaaatattttgataaagctattttttcccttaaattatatgtcagcatggagttggtgtgtattttctgttaatgatttggaatttttaaagccatatttcaaaaacagacaggctcttctgagttaggctccgccatccatcctggtttcctgtcttcattccatcctgagtgcaagaggatggcagttttcagtttgcaccagaacacagaaccaatgaaatccccatatcccaggttgcagcaaatctggaatgtgaattggtcctgtgggaatagctggacttggcccagcacaactctggacacagaaggtcaccctgagatcagaaggtgaagataaacgcttaaaccccccgtcagcagcagcaactcctccgacagtgatgctggaggctgaaggacctgttaaaacaaggactactaatcttatttttccaattacccttatctgacatttctatctcttcctccttcccacctccccactgctgccttagagtgacaccttttggaaaaggttgaaactgaaaatccccagactgctttcagcctggacctgaccatccctaagactgtgtttgtgatttgttttctcctcattgaagtttaagcatcaaggagctttgcttacattggttgcctctgatccttctcctgcaaacaaatgcccacattaagaacatttgtttgggctccaactctttgattttgacaacgtttcacattctccctttcctcttctcttctcaggcctattaacaaaacttcacaccataataaaagaaggatagagaggaaatgtgcaaaaatacatacatctgacttaacagagtctgttaaatgagaaagtgtcagagtacaaatgaatgacactttctccaaaatgcccttgagcactcttcattccagatgggattgggctcagtggaagttcctcaagaaaaaggctgtgggggtgtgcttctgggtatgtggtgtaggggtatatctcgagcagctgggaggctttattacacgtgtgtcacagttctgcagtgtggcaaagagatggccttctctctaacagcctgggacattcttgagaagcagtatagggatagtaaaggatgtggactctgaagtcagaaagcctaggtccccatcaggccccagctacatgctgacggtgtgattttaggaaaggagcttgacctctatgtacgtcagcttcctcttctacaaaatgtaaataataactgcaccttccggagaccttgtgaggaatacgggcagtacaacagcaacatgcttggcacacagtaagcatgcaaccacccgagattgtcatcaacagtggtattagcttaaacactagtacttcattttcagcctataagaggatgcataagcaagacaaagggttggatttccattttttttttacattttccaaaagatgcatcacatttttcatcttcagtggaaaggtgaaaattttcaccaagaaacccgctttgtaacaaaccaaattaatcatacacaaaatatgcattgttcatattttaatcttacttaggctaaattccaaacataaagatgaaggaactggagaagaaaatagagaagcatcgcacagtagatcttcctgcaatgctggcaacgttgtaactttttctgcccaatatgtatgccactaactacatgcggcacttccaatgtgtctggtgcaaaccaggaaatgaattcttaacttaatttaacattaattaaaatttaaatgtaaatagtcacaggtctattggctactgcattagaaagaacaatatgagaacataccattttcacaactttgttgtccaatggtgatgttcagaaattatttcggtctttgtggaacatttaccttttttggtcacgggaaacaaacatttcaattcttttaaattcagtataactaatgaattactatttgatctgatgattctactttctggatttattctaaggatatataataagggattttcccagacgaatttactctaaggatataataagcatattcatcacaatgttatttataaaaatcagaataaaagtttgtatgtgtatggatatatttacatacatatacacaatacatacatacacaaacatatatgtatacaatcttcaaaaaaattagttacaaaaattatggaatacgtgtgtgagtgtgtgtgtgtgagagagagagtgtgtgtgtgatttaaaagtgttacaaagaaattaaataataaattatgggcacccaattgttgagatgttcgtcagatattaaacactaagcaaaaagatttaacgtaaaggaaagatgctcatgaaatcttaagtgaggaaagcaggtggtaaatggtagatacaatacaatctcaactatgtgttgggatttttttgcatattcgtaggagaaaagactagagggaaatgtatcaaaatattcatgatgggtttgtttctaggtttagggatttcacatactctattatatatttctttgtacttattgataaaaatatgtattacaaatgtttacaaaaagagtaattaaaccaatttcaactaagaaagatctgcctaggaaatatttctgatcccatggaaaaagcagttgcaggtaaacatagcctctaaaggacaggtatgaagcagtcctccagaaaaagatggggccctctggcggcagttacaatggcagctaactttagccaaaatgaccttaagatgggctactctttaaggcaggggtactttggttctgagagtcccttagattatactggttataatccggtggggagagcccaattgttggtgactctagagctgtcaacagtaattcctgccgcctccaccctgccccacaatgcactttactcatttcactttgttctctaataaagttcctatgggttttggaagtccaatatgttcattttctttcttattttgtttggtgctttgtttagtattgtccgattttgttattataattttgtttcttcagcactcaaaataagctgtgaggccctagaaaatcaaaaccatttgtccaggctacttggccacctccattagcagagtctgttcattcccattcaacaaatcagggtggtgttctcaaacaaacccactttcttataatgcaaggatcagtgctgggacaattccaaggaaggagaagaaaatgggtttcctttactttgagttcccctactgacttggctctggaagagacacctattgatgatgacaaatttctatcagctcaaatcaagcctgactccaagcctgatacctcaggatccttgcatcacaagatctaccttgaacaatagggagtggcttccctatatgtcaccttgctcttttaagcacacagagtccaaagcacccttgcatcctccacctggcacagcctcttctcaaacacacagtagatagtcaacagatgtgggagggaggttggaagggagaaaagaagaaaaggagccatactgtagaaaggtaatcattactggtgatttagataatatcctatttgattctcacatattcccaaagaagcagaccatttaaatgatggataacttaagctcagaaagggtaaaggattttcaagtggtttactttttaccaggatgtaagactgattgttgaatacaaatataatggaagaagtgttagaggggactctactgagaggctctgggaggaaacccaggaccacaagaccctcaagagcaagaaaatccctggctcattttctatcacatagtcagcaccaacaaatgcgtggatgaacataaattagtgatggatcttgggtctcttttgtttcactggagtagaatagtcattatctgttttgatcccagcactgttccaaaatgccttagttgatttttgtattctatttcagttttccattattgtacaataaattatagtaaacttggctgcttatagttctacaggtcagaagtctaggcaaggtgtgactggggtctccacttagagtctcataaggttgctatcaagatattggcaggctgctttctcatctggagcagctcagggtcctcttccaagctcatggagttgaaagattattcaattccttgcagatgtgggtctgaggtcaccttgtcatgtccagctcattgaagccacctgtattctttgccgcacagtcccctcaaatctttaaagccagcaaatggagaatctccctcacatcaaatccatctcatgctttaactctccttcttctgtaaaagcccagtcccatttaagggctcaccttaaggattaattaagtcaggcccaccaaagataatgtccctttcttaaagtcaactgtgccaaataacatgcttaatcacgtgagtgacatcccatcacttccacagtcactatccataagatcgatgaggccattcccatactctgaaggaagaatccctccacaaaatatcatagctttgaagacttcagcagataattttcatgttgtaaatgccatctagtcccaaggatgactacacactaggtgaagcaacattcgaatcagtgacttgataccgactgaatcaggatatgaaattgactttcttaagagtcatgtgataaaaatgtcataattgtgttccctttttataaaacaaaccatcacacacaaacacagacacatgcattttaagtgtcatgttcagcaatagctaccagtgcatcttatgctaacccatagataccaccagcaggtaccggtttccttattattataattcaggtaagtaaaaaaatcacagtaaagcttcatcatcctccaactaaatatatcctccagactgctggcttggttagctcctcagtgggaggaaagcaaaaaccagacataacgtgccagaatgaagtcttccgcttcaatttctcctttatttaaaacattttataggggctttatgttgaccctattgcttcaggagaaggaaatcctcccaaatgcgtccctagggcacagcatcccccacagtgacttggctccctcctctcggcgattactgcgacatggaaaaagttcttaattggttaaccttgggaaaaatcacttcatacagggaaaactcagaacaaagacgcccacccaaacagtcagttctccccacgtacaaagcggctggtaaggagtatgagaggcaccacatgagcaaggctgaccgacagaacttagctgcattttaaagctaaatagagggttcctatgctttccttccatctccaaatggaataagtattcacacaatcacaagagtagatccgctaaaccttgcctctcttccagtcatcagcgtgctgctcagcatcctctttgtaccccagggaaggagactgctttctggccatccagctgaactaatgagagtggggttttgacactgggctcctaggaccagttactctgcttctcacctggctccacaccagagattatcccctagcccctgccaggggctgtgatttatcccaagggagcctggcggagagtgggcggatggcaaaggtcaaattcagcccactcctataaaaacaaccaaagtacacatcctgatgtgcataattttcatgcttaaaatcagcaacttttgtctttctggattatcttgattcatggaaacattcactgttcatctgggcagaaacaaaacatactcacatcttaacatgtgacactttcacaactgggatgaaaagctatctgccagattgtaccatttatattcacctattaaactccaagcttcaccaaatacctgtatcatgctttggaaatagacatctatgttttccccaaaagacacattttctacgatgtatgtctttaaactatattttcaaaataaatgattttccctagtagctcttctctgattaaaaaaaattcaccattttcattaccaatatgagattatagtctagtctcctataaagtgattaaacataactctgcatcaaatgtaactctggtatcaaatagtctcaagacaaataaaagtgaaaacattggattccttgctttttaaatgccaaatgttcactcaaggatctgattgcttcagctgggactttttctttcttgtacagcttctgaaatatttaaattgctttgtttaaaaatatttctccttatttttcctctcatttcttcaagaatatatagctataataaaaccatgatacccagagttcaagaggaaaaacagcctcattatttaaaataagtaataattatacatatatcgaaatgaataccccattttgatgggtcacattcagaaaccttaaaggcacctctatctgggcaatagttccttttggactaaaaacaattaggctgtgtaattttgtgctgaatcccttcagataactgtgtacgcacagccaggccactttctcactggcatggaggccagggctgtcaggcccactcctctggttaatgtcagtagcactatgtataaaaggtgactccagtgtgtacaaatgttgatctttagagaagtcatgcctagactcacacacacatccactcttttgcccagtaggtcaacagcaggaacagagggcagcccaggaagggacttgccaagagcagaggcttatttgttaggttacatagccctcggggactttcttgcctgagattaatccataatcctgtttcgtgtttaaaaattcaggttctaaaagccttgcctatgagacattttcagaggtgatggagaaatgttctcatgtacagcaacaaattaagtgccagtgcaagtgagcactgacaagaaaggaactgtgtggaataggtggcacaacatttttgccctcatccaaaatcatttctttaaagttccaaaatggatacagatcatattttaatggccagagtaccataggtaaaaatagaataaacacacacacacaagttgaaaccatctatggcttttctgattgctgcacaagtaaagcaaaatcaagatgccccctgatcgaaaatacagcagaggttctgaagaaatataatattcgctgatgtgacttccaaactaaatttcatctgaataccaaatagtaagaagagccctcatctcagctttgaacaatcctatttttattacatcaaaattgtttcttcccttgccaacctcattctacccctttttgctacaaacttaatgtccagaaagcttccttttacaactctagcagacccaaccaaaaaaagcaggaattcctaatgctgcagaaaccatcatgaacatgttctcatctggatgagtctaataaagtataactcactctactcttcagtgaagaaagaaagcgtctggggggaaacacatttctgaacaagatggccatgtgaactcctcaacaccctagaccaccgaggtgtggacagagccagctggcctcgtggcatcttctccttcaatttagacagaaagaaaagcatgacagttaataatccacattgccatttcaatgtgtgactcagcccgttttcacggtcattcctgctaaggtttaacttacagtgtttggcaacagagctgaccttttaaaagccaaaggtgagcatgggaagagcattttctccccagatgcaacttctctagtctaacaaaagcagctcccgtttccaaatatgaacaaaaaaggagacaaatcaccaagcttgttgcctatgtcttgatgtgtttcacgttcttctttttgagacagagtctcactctgttgcccaagctgcagtgcagtggctcaatctcggctcactgcaacctctgcctcccgggttcaagcaattctcctgcctcagcctcctgagtagctaggaccacaggcatgcaccatcacgcccagctaatttttgtatttttagtagagatggggtttcaccatgttagtcaggttggtctcgaactcctgacctcaagcaatccacctgcctcagcctcccaaagtgctgggattacaggcgtgagccaccacgcacattcttctttttactttttttgtggacctcacagtttggagtagtggtggtggtggtggtggtggtcgtgtgtgtgtgcagcatccctcccgccccctccctccataggccctagcacacgctcttccacttaacagtaactccgaggggaagtcaccatttgtataggtggaggaagccaaaaccctacaacagagcagactaaggaattttcacacctataagcattgacttccaaaatcaaaatataattttgaaagaggcggtatagtatctattgccttgcaaataaaaccccaactccttcctgcagctgacaagggccctgtattgtcaagacccctactcaactacatcccatgcaacccttgccttgtagaatctgttctttcttaccatgccttgtttccaggccccttctcccaaactcttcaaatagcaggcatcttctaaactgtcaggtcttggcataaatgtcaccacctcccaaaggcccttctgagtcccttcagataaaggagctgcctgcctcccacctgtccctggtattcttcatctcagctccaagttggatttcctcatagcatgtgtcacaattttaaatgactttacttaagaatttccttctatgtaccttcccatttccttcacaaggctttttgctccatgtctaacttactcctcctgtatttgtaatacccatcctgaggcctggcacatggctgacacttagtaagtactcacctgactcataactagaattagcaaaaacaatacctgatgtttatgccagtggttgtcaaagtagtggcagggggggccgggcgcggtggctcacgaggtcaggagatcgagaccaccctggctaacacggtgaaaccccatctctactaaaaatacaaaaaattagccgggcatggtggcaggcgcctgtagtcccagctactcgggcggctgaggcaggagaatggcgtgaacccgggaggcggagcttgcagtgagccgagatcgcgccactgcactccagcctgggtgacagagcgagactctgtctcaaaaaaaaaaaaaaaaaaaaaagtagtggcagggggttccccaaccagcagcagcagcatcacctggaaatgtatttgaatgtacgttctcagcatcctcccatcccatgtttctacctattgaatcagaaactgaggatgcggtccaacaatatgtgttttaacaacccttctgattgattctgattctgatgcatgttcaagttccagaactactgcttcacacaatattgcccactttccaaagggcattcaaacacagatgttgtaggcctgcctgtaatcgggaaaggaagagtgagcaccattttgcaggagacttatctttacaggcaaagaggctgtgaacattcatcctggaaaagaccccatgttgatgagtgtttctgtgtttgggggagtctctgtgaaaggaaccaatttatgcaaaggattccctggctcatttctattcaatcagagggtgatcaggctgagtatgatgatgccgcagccatatcactggcatgggaatcctgccttttctgtagtgatggcccagatgataggggtgcttgcctcccagtcttcatcttgagggtaaggtttcctgaaaacagatactgccttgtcatgtatgcaccctggccttcacccaacacctagcacacagtggtgaatcagaaagtgtctgcaaaagaaccagtagctgaagtagtggtgatgtcacctgtattgctgggagaaaacatgcaagagggctttgcttgccggatttatcagtaggctagtagcttttatatggtaaagtggttcaaaaacatgctgggtagagaaagaatgcaagacttagagttaagaaagatcccagttcaaatcccggccacttgctcctgtatgtctttggccaaggtagctagccttgctgagcctctgattccttaactgtaaatggagatatcatgccctgctgcacagggctcttgtgaggattatgtgagattgcaggataaagtgtctagaatagcatcaggtacgtactcagtgccaagatgctgtaatgacccatattagcattattgcttaattgtttgactggagaaaatgaatcagaggtctttgtctctgatataatgtgtattctgtaatttgatgtaacagagctacagaagggcattcctgcccaccccatagttttcagtgtgatgggagagatccatcagtataaaacatgaggaaacacagacgctgagtttggactgatgaaggctcagatcccttctctgccacttaccagctgtgtgaccttgagcaagccacttacactctctgggcttctgcatttgtagattggagataataacacacttcactcagggtcatagcaaggactggagattaaaatatccatgaaacactcagccctgtgcctagcccttagtaagcacttgataaacgataagtattatttactaaaaccaacaataggcagggcagaattccacctctgctacagaagaggcagacagggaggagcagagtgttagaggcaaaaacaaagaggggacgatacattgggaaaagcaacacacagggagaggaggcttcccagaagtgatagcgtttaaatgacaggggtcaccaactcaaaggctggtagggcgaagcagttattgtcaaggcctgatgctggccaggaagggaaatgccctttagctgctgctaatttccaccatgtaaacatgcaggttctacatggccagatcccctgatttatcaaaagaagcaaacatatctgaattttcctgaaaaaaatcttattttttaattagtgcttcaatcaaagagaaaaatatcctgcctgaattgaactacacacattataggccacatctggatcatgaatgatcagttttgaggccttattttaaaggatgactagagttttgtcaagcagggttggtggaaagagcattctagcaaggaaagagtatgggctgggacagggaggcaggaaaggccaggaaatgttcagaaagcagaattctgctccaggggactgagagtgaacagaggaggaaaggaagagtcagggagcgatgctcagagggagaagccttccagggagagatgtgggctgggctggcaggtgagtccgagaatgctgacaaggagaaggaaggagttagaaatgatagaagagcaggcagctggccggtcactctcttcccctctttgggacgcagttttccttgctataaactgagctcatgaattagatgagctttaagccctcttctagccccatccataacattcaggggggtcaccacaactcctacacgttgggttgccatatcagctcctgtgctctaggttctggggaatgctgttctagcttaccatcaaggaagaaaagggtcacgtgcctgccccaaggaccaccttttctagccataggggacaagctaacttaagtaatgcagagaaaactgtgggcaataagtatagagtcaatcctgacatgaagtagtccctcgaataataacacatgcatcttcattgaatacccattttgagccagactctggcccacttaccggacagaacaatgtctaaggtcccactattatttccatgttacagatcaggcacaggatggttaaataggtctacagccaaaaagctggaaaatggtaggaccagcagtcaaacaggaagtcagtctaatgccagccccttccatctcggcccctctgccaagctgccttcctctagatcctttcatatccgtgtttcggtgctgcacttctttcacaatggcgtctgaaattatgtgttggtataactcaactgggaacattccttggccacatcaggacagactaaaaaccagagttccctctcctgctccagaaggtggccaaaagtttgagtcctggggagttttgtacttctcttgatacagaggagagataaaaggtctttgttcccaagaatctgggatcttggtccaaggagtcaaattgtcagaatgagtttgaataagcagggagtagctgggcttggagagatggggatttctgcctgcggtggctgtgtagatctcacagacagaaggggtttgaagtgcattccattccaagaagctctccagagcagggagacaagaagcagaggactgaaacctaagggtaaaggttcaggcagccatgggagggagtgtgtcagcaactatctttggcacggaccctgagcatcccggaggcagccaccctgggacaaagaccacaggccttccctcaatcactctgggcaaattaagagaaccctgagggacagagagggaccctcataaagtctgagatttatttttctaccaaacatgacagatgaggtgaggggttgtcaattaacatttaatttgacttagaaaacacaaaatattaggtttttgcatccaaatatcatgggataaatttggccaatgataatcatttacgtggaaaaatatttatattgagaaggcctcatttgtttgaggaattttgtccatgtgaatacaaaaagccttccctctctcacatacatatacgttatgtattcaggttgttttttttctctaaatattctgtttaggttgaatcaatgactagtctataagataaaggtaaaactctattttaagaaaacattgggctggccacagtggcttacacctgtaatctcagcactttgggaggcagatgggggcagatcacttgaagccaagagttggagaccagcctggccaacatgttgaaacctggtctctgctaaaaaatacaaaaaaaatagctggcatggtggtgtacgcctgtaatcccagctactccggaggctgaggcacaaaaatcccttggacctgggaggtggaggttgtagtgagccgagatcacaccactgcattccagcccgggtgacagagcaagactctgtctcaacaaaaaaacaaaaaaacaaaaaaaacaaaacaaaacaaaagaaagcaagaaaaacaaaacattaatgtgtgtatatatgtatatatgtagacatataaatatgtgtttctaactctgctggaaatgagagataaaccaaatattctaggggtttccctaagagtcaacatcaataccccaaaactaattaactaataagtattaatactaattaacaattgcatggcattaattttgtgccaggcatggatctaaatcttgtgagtatgaacaatcgtctgtaataccatttatttctcacagcaccctgttgagtcatcattatcattttacagatgatgaaactgagacacaaagaggttaagcaacttgcccacagtcacacagctagtgagtggcacagctgggatttgaacccaggctgtcagtctctacagtctgataaccactagaatattttgctttgtaacatctgttgtaaggattaaaggtaaaaatgtatcacttttcaagctttctagaaattctttcactaattcaacacacttattgtggcactatgccagggatgagggatgcaatccctgcactcatggtgctcatagtctagcaaataacttctcttcttcccctttccctccctccctgcgctctgtccctctctttgtcccaaggaaattatccacatgaacagactttatttcacaacttcatctaaaaactcacatgcacataccctgatgatgtaacttaacaggtctaacaaaacctcaaatttacaaatttaaaaaagaaaatcaccaacccaaagagaggaggacgtggcccaatgggaaataaacccaaattgctaagacacatacagcactaaaatctagaaggcttcaaagataacatttgccactattgagagatttcttgtgctttcaaagtccacaagcagagagtggttcataaacatcctgtctaaatgtaatattggaggcctgtctcaaggtaatattctagtaagggaaagagcattgacttcatcgtaagcggctagtctgccgctgatggcagactaagactggaatgtgcagataattatctttaaggccagtcaacggctatatgtctcctataatatcacctttaagatcaagccaagacattccagtctgaatcaaggtttatttatgaaaggatttaacacttttagatcccatattgcttggaggaccaccaatttgcattcccaaatacccaatttcttcaatttcacagagcatgaatgagatttcaggttctcatatgttagagggaaaaatttaagacactaaaattccttttcttcaatgaggtgaatttctttgctaacacctccacaaaataaaatcaccactagggacttaaagtagcaaatatcataagtcataatgccacattcatgtagatataaccaaattttcaggtatttccagctgaatggtctctcttgttccactcaaacttgaaaggtcaaaggagcaatttgattgtgggtgctctatacagaccacagacaggaggaggaatggcccttctaccagcaagggcacaacacttaaaggggcatgcagacagctgaaacccaaatgaacccccatacattggagtgatctaccaaagggaaccagttaatcaggaaggctgtatgagtttcctcattggtggtggtagggattgatcagacatccgttttaaagaaccggtataaatattggcttaaactagaccagaaccagcatagtatggggtgtggagagagaggtggtggtacctacccacaggtgaggagagagagaagaaatctcagaagagatatcccagagctggtatttcagccctacaatgatacttgatggttgccagtgcgagtgagaaagataatgatgaccatggaggttgccaacagatattaaatcaacccatcattttatagggaacatagtagcattcatttgataacatcagcacactgaaatagtttaaaaatgaagcaagaaaaaaatgaaaagtgacttcagttgaagaacagtcaaatgccttgtctttattattaccctactgtatgtatgtgtgtgcatgtgtaagtgtatatttacttttatatgaaaatccaaccctcttgatggtcatatttatcactctaaactaataaagagccattctaattttctaagacaaaattaaatgtacatatacacatatttgtacacatagtagagaaggctgtttggaaagaaatatatcagggaattaacagtggttttccttgattatgaatcatgggctctttttttctatttctcattactcaaacccaaaatagctttactgatactttgaccccaattataaaaataatgcatatttatgtcttgttaatattaaacatacaggaaagtatgagagagagaaagaaaagcaaaacaaaatcacaagcacaaacccaggacccagaggaacactgagggccatttttatagacttccaaattttttccatcagtgcttcttcttttaacaagtcaatcatgctacacatactgttttatggctttctttttttattgcatttatttatttagagatggggtcttgctctgttgcccaggctggagtataatggtgtgatcatagctcactgcagccttgaactcctgggctcaagcaatcctcccacttcagcctcctgagtagctaagactatgggtgcatgccaccacacctggctatttttctttttttagagacaggtcttgctatgttgtccagtctggtccttccttttagctcgacaaaataacatggatgttttctctatcgataaatattgatctagttcattttttcatggccacagtgtaatctataagaatcacctcctgggggtcttatggttatttccaaattttttaatttataaataagagtagataaatcatatctaaatattttctttgccaacaatctggtgattacttaagagaaattcccagaaagctacttgctggttcgaaggacatgtacatctttatggtttagtgcacatacctataaattggtctcctgaaaaaccacaaaaatccagaaacagaggtatattttattttcttctttttgtttttctgtattttttgtaacttacttttttgctgacgttatacttaaaaattgcttctacaaaaggaaaaaaaaatattttatggaaaaagaaaagggacaattggaagatgactttttccaatggagaattttgatctatgggacaggactttcccagaaagaagatggggacacaagacttgacactactgtccattaaactcaccacctcacctcccttgctcatgcccatcatccagacttttcacacacagtcatctacaggaggaaatgcagtgatgagcaagcctcagtattcactctttacatggttctagctaacactgcatcaataaaagaccactctgtaccctttttctagtagtatctcccttgaagctagagattcaaaagaatccaccttagattgaagcgggactttccaatttccttcccttattcttaaactaataaaatattcttgcccctttatgacaatttttttttttttaaagataacacagcccagctgaaccaggagtgaggaacaaggagactggatactcatcttgagaaaagtctccaaaagtgatcaatttaaaaaatattttcagttattattttcatgaagtttgttaactctgatgcaaagatgtctctgaaatctctagatatacacagaaattagtcaacaactgaggttttttctgtatgggctagtttcccaccaaccagagccacgcgctcccaaaccctttctgttcttagtctcactccctctaatgtcaaacctggctaaactaggggctggagactgggtctcttatctttaaatgttacattattcttaacactctctattggctaaaaatgaaacagaagttcagaaaactcacaggccacgaatctgcttacttcagaggtcacctttaagatttaagaatactgccagcttttcactttaacatggtacccactcctacccaaatcctctttctgttgatacacatacaacttgattcttaccacttctagaaagccatcgccctactactcgtcctctccttagatgcaaggtctgagaattcatgaactcccctgatgcaagtgacctactggctaagcttcacctcaggccagaagaaacaactggcccatgcattgcaccattttccaaccagcagatgtaaacacatgtaaacctaggcccacaaaggaagcagctacttcttaaaagttgactttgatgatctcttgaactttatcccataaaactagacacccaccattgcaagatggaaggtgaggagctagaggtgtgctttctttctggacattcttccttctaagtgctaaccataccagcagtcctctatttgggaacataggtcattattttaatgcatataaaaagcaaacaattaagatagaaccaaagattttaaaaataatctaattttgaagcatcttgcctttcagattcagtcttttataaaatctatgccgtcgtcgcatatttcatacacactttttaatttgatccaccctatcgttgaaatgctcatatccatagtgtcctgagtaagtctcaggatggacatttgtcaggatattagtaatttccatatttgtctctactttaccaagtatataaaccctatgctgtttaacattatttcagcactttttaaagcaaaaataaaatatagtgattttaaaattaatataattatacgatcattgctgtaccaacaaagattatgacgcttatgttggcttacagaagacgtttccatagaacagacagaaacggtcattttagctaattaaaaaaaaagtctgcagtacaacaaagggctgttatggaggtatgtagcatataaaatcaaactcacgagaaccaagaatcacttatattaatttataatacaccttggtttcagaaagaaatggctgtgtttttaatattttaggcctcttgataaaattctgtcacatgacagctatacatttggttatgagaaaagtgaatttggattcatgaaagacacatgacatttgagctaatggggatgtacaataacatcccatggatccttatggatgtcaatacacctgacaagtaatagctttcctaccttctgactggctgaaggattggaagcaagataaccaccctcactagtagtacatgtatacagaaagacaacagcctcaattaagatcatcgaggggagctgacttaatttggggaggtgcctatccagaggctttgtgatcacttcctaaatttattgctgtattgtagagagcaagaattctggataagtaaggtcctaaaatgtaagaagttacagatggctccaaaatttatttgaatctttaaaaaatgattacagattttaagacaaaaaaatcacttaagtccttcctagtaataaatattttcaaaatagaacatgcatattcatagtatttgtaataaggccatcccaactcacacacagagctgctgatgcaaagtcctagagcatgaactctgctgcgaggtcaagccaggccattctgagaggagtgctaagtccttcaaccactgcagacccattcagctcactgtggcaacagcgtggtgagaatatttcagtgagaatattccagtggcctggaagaatgagtgtacttcacaaagcacccaatttattcccataaaatgcctagcatgccaattgactttaggctcattttacacaaaaatctaggtttttggaaagatttactcttgggtttccaaatgtttattgccttgctgacagatttttagactggtgcttgtaacaggtgatttttcacaacacaaggaatccaaaatgcaattccaggacactaagcaaaaactatctctaagattccagttggtgtcaaatcacatagaacctagaatatgcaagcagagaagtaaaaatgcttcttcgttaataatcacatgtgcgctagtatagtatcatcaaaagttacaccgactacacctcccactcatccatgcctactggtatgttctctgttcagcaaatgcactgagcgtgttcccactgcaggtagcttgcatttgctgttcctaccacccagagttcgcccattccagtgcttgtaggttggctcctgactgttattcagcttcaggagtagccctgctgcctctccaagccacactgtatataatatggcctggctgacttccttcatagcatatattacaatctccaactctcttgttcattttaaaaacatgtattttttgttaatgagggcaagacttggtctttcttgcccttctgttcctagtacctggaatagtatttaggacaggggtgggcactcaataaatatatgctaaataaatgagtaaacagtttaattaatcaaaagtactaggggtttttttgcactaaagtgcaaagccatgaggtatgatttgtattgtattgtaattattccattattataaaaacaagatatatttgagaaaagccatatgaaaattaggtcataatctgaagaatgaagaggattccattaactcactagttcccaaaattccatcatgaaggtcccctgttgtagtttttcttccatgatgccaatggtttgaaataaaatgcttttcaaacccactggcttctagtaaatcagtttgtatacccttatacactttctaacaagatttttgcaagaaaaaataaatggcaggggtaaaaacttgttaatgaatgttcatagcaacattccttataatggccaaaagcagaaacaacccaaatgtcatcaaccaatgaacagataaataaaatatgatatatccatatagccatgcaatggaacattattcctaacaataaatgaaatactaatacatgctgccacatggatgagccttgaaaacattatcctaagaaaaagaagccagatacaaaaggccataggctatatgattccatttatatgaaatatatgaataggcaaatctataaactatataattccatttatatgaaatgtatgaataggcaaatccataaagacagaaaacagattagtggttactggaagctggggtttgaggaagggcagggggagtgtggaataactggttataggtacagagtttccttttgaggtaacaaaaatgttctaaaattgattgcacaactctgaatatgctgaaaatcattgaatgctacactttaaatggtgaattgcatggtatgtgaattatatctcaataaggctgctacatatttttctaaatgctttgtggataccagttatatctttgagaatggagctagatgattaattctcatccagaccaaaagtctacaaataaagacactatctgctaattgagagttgccttgattaagaaaatgctagctgctctaacagagaaacactgaaatctcggtggcttattataagtttatttctagctcaaattttttctgtctagtggtttcactatcctttagcctgggcctcagagtcccagtatatcttctatatctagatatcatatagagataagacaatagatcacaccaaagctatttatattccaggtctgaaaatggaaaaggataagttactttcattgaccgaagcttggtcttatggccatttctagctacaatgtaatctggaaatgtaatgtatatctaggagtaagaggaatcaggttttgttgaaggtatagcagagacttactccctcagggtttactgtcttaaaaaataaaaaggtgggggcagggtgatctatgagcatctgttttgtctcactcttcctccgaatatcttccttcttaacaataaattggtgccagtcagggaataaattggtaaaactaccttacagagaaatttggcaatatgtaataaagttaaagatgtgtgaaaattatggcccaaggtgctagattagaaaaacataaccacgagttttttcagcttttcattccttaaatctgggctggccttgggacttgcttagaccaatagaatgtggtggaaatgatgcactgtgtgcatttcagagtcaaagccttaaaaggccttgaagcttcttcttgaaacactgtcttaagaatgctgtgctgttaggaagctgatccaccctatcataggataagaagccatatggagatctgaagtgccctagctacaggcagcaccaacaaccagatatgtaagtggggccacatcagaccattcactcattctagacatcacctgactgcaactagatgaagaagactagctaaagaatcatgccaaaacacagcattgtgtaaatcattattttaagccagtaagtttggggtgttctgttatgcagcaatagattcctgatataaacaagaattttaacttcaaatacacactaaagatatattctcatacgttttctcaaagagaaatgctcaagaatgtccaccacagcattgtttgcaaaaggaaaaatacaaaaataactaatatggcaaccattaccaaaaaatggatatttaaagtatgatgtaggtaggatgcagtggttcacgcctgtaatcctaacactttgggtggccaaagtgggaggattgcttgaggccaggagttcaagaccagcctgggcaacataacaagaccttatctctacaaaaagtttcaaaattagcagggcacagtggcacatgcctgcagtcctagctacttggaagactgaagtgagaggatggcttcagcccaggagtttgaagctgtcatgagctatgaccatgccactgcactccaatctaggcaacatagtaagaccgtctctaaaaaaaatcatttaaaaaagtatgatgccaatggagcgctatgcagcaatgaaaataaaacagagctacaggtatcaattggataaacttcaaaaacatactattaagaaattaacatgaattgcccagtgatacacatttattcaatcaacaaatatttattgaacaatttgtaggtatctggaatacacccccacaacctcacaactttatcttcaacgaacatgtattctagtggtaggagacagccaaaacagaagaaaataagtaaaatgtgtaataactgagacagtgaagagtgctaaagagaataataaagcagaagaaggagatgaccgacttgcaattttaggtggggtagcccaggaaggccctaaggcagagccatgtaaataagacttgagggggtagtaaaccagccagtggctatcaggggaagggcattttaggcaaagggaattgcaagtgcaaaagccccaaggtggaagggcctcctgtgcgttcaaggaataaggaggaggccactgagtaattggcctaataagtgaagttaatgaataaagaagaaagtatgaagccatttatgttgcacttaagaatgcagaaaataatagcacatattatctgtgaattcataacatctagtaaaattacaaaaatagtctacattggttaggaatacacacatatgtcaaataagtataaaaattagtatggccggatgcacattacattttggagaggattctctttgagaaaaatggagatacatggaatcaggatggagtaaaatattttatctctttaaaaatgtcaagcaaatatgaaaaaattatttatttattaagtaaaatttaatttgtattgagtgttgggtaaatggatttcattacactattttctgtattttccattatgtttgaaatatttcataattggttttaaaaaggcactaaacgaataaatatttcatcaacaatcagcaactgttgtttaaatgagaagatctagttacacatacacacaggcacactaaaacacacacacacacacacacacacacacacaccccaagtgagaaggatattgctaactgtccaaaaactcaacaggcatctgggtgatgggcttcactgaaaaggacatcatctctccctggaggtaacaatcaacacatttcatgcataatattatgtaagatttaatccatatcttgttatcttaattctattttaataatggcatacatcaacatgaattctacttgaaccctttagtgcttctttatctgcttctaatacaattttaaagaaggatttgaatgtaaaattcattctaaataatagagcacgtgattctgcaaaactgaagaggaagtggggaggttaataatgataacagtgacaataattgtatggcattcattggatgctcagtatttgtcagtcacttttccaaattcctatcttgtttttcctaccaaccctatgaggttatcccatttgaccacagaagaacagaggggcagagtgagtgacatgcccaaggtcacacagctagaaagtgatgacactgggcttcaaacctagggggctaagtttgatggcagagactgaatcataaccactcggttctggtgggaatgcagaaacctctgagcacaccctaaaacctctctcacaatttgctgcttatgtactaaagtaaaaactgactgtgaatgtgtttgtgcaattaggcaataaattattaactacatggttcatatttgctttaattgatgggattagcggcttcaattgaatcagtgtgaaccttaattacccaccaacatgaatttgaaatctggctgactctggtaaataaaaatatatccataaaactgcacccaaaatagttatgaccctttaaactcttataaacactatcatccttattatggtgttggtgtttggggaagagggggcagggtccgatctagctctgagaattgcctcctgattctcactgaactcctcattcatttctttgaaggcggtattcccacatgtatcagtcctacagagttttatcaggcaaggtttggagattgcttctctactgggaattctcaatatgacagttcaaaattctgtcatcgcaaactgaacaatcaacctgaatatggtttttaaaaaatgagatgctgagacaatgaatacaatgcaatggcttctaagatcattatagccaaagttggaaaatgcaaattattttattttattttgagccacaaaaatgaaaaagaactagcatataacttttctactagttttgtattaataggagatttaaatatgaatgtagtccatatatggagagtattaattcttataactgaaaaatcatgttttctaggaattatgtgcaattgggaacatcaaaaaagtacttaatgggacatcttaaaaacaaattcattgttggttaatcaattctttcagataatttctactgttaatataactaatagtttcctaatttaagtgaagctttgttaaatgatatcagactctctctacctctttgctcttgctaaattctaacgattgtataatatcaacccagagatactgctttgccctacacattagctcatacagagaaatgtattcattcagaagtcttcccagacatacctcctccagtcacttagtcttcaaactaaataagtggactagaactttctagcaactgtctcagaatacttctgacccacatagtttcaaatcagttactttaagtacattaaagcttaatttaaactatttttattactgggagcaaggtaaattcatgctcccagagtgacgtttctaacaaaaccaactcaaactttgcttcactaaaatatagccacccaggggaaaaacatcataaagatagtaattatggtgagataatcaaaggcctccacactgaaaaaaaaaattgtcctaaaaatgtcacttgtgggttttgaggctttggagccttgcaaggggcttattttaaacagaaatccagcggaagcaacacacttttggtctctctgtgtctcccctcccctttctctcactcttgggaagaagaaaagatgccagtagaaaaacatcaaacagctcttctccccctacccccttctttctttgtcttaatttctacagttgcttcaaaacatccccattttacttagaatctttttcctctcagatgttcctggcttgtaattacaatcaaacagagatcctacgtaactgtcctcaagaccttccaggtcccccacagggaaattcccagctgaaactgcatctgtctcttgctctttaaagaaaccagcagtaagaattaactataaaagttgactcaatttgaatggacagctctcaaaaaaaggaaacacaataagcacatgaacaagatgctcaacatcaccagatattggggagatgcaaataaaaccacagtgagatggctgttgtcaaaaagtattggtgaggatgtgggggaattggaggcctgtgcattgccggtgaaaaagcaaaatggtgtagctactgtggaaaacagtatggcagctcctcaaaatattgggaatggaattaccatacagtccatcaattccactctgggtagatgcccaaaagaattaaaagcagggacttgaacagatatgtatatatcactgttcataggagcatgattcacaatagccaggaagtagaaacaacccaagtgtctattgaagatgaatgaataaacaaaatgtgatatatacatgcaatggaaaatattccattattcatccttaaaaaggaaaattctgacacatgctacacacagatgaaccctgaagacatcgagttaagtgaaataaaccagacataaaaagaaaaatattgtatgactcggctcatttgaggtacttagagtaattaaattcataaagccagaaaataaaacacaggttgccagggaccaggggtatgaggttattggtgagttactgtttaacagatatagagtttcagttctgggatggatgacagtgatagttacacaacactttgaatgtatttaaagccactggtaaaatggtaaatgttatgttatatatattttgccacaataaaaaaaaagttggttcagaagatataatagcaaacaaggaattattttcaatttatttataaaagcaatagcttttataaatctgtctcttcagttgcagctccaggataggctacaaataaagggattctgggttgtagaggctctcctcttagtgacctcagatcagagtctagattgtggtagacagaatcacaacaattcatgcctttaaattttctactgctttagggagaagcctctagcttaagacaaatggatctcatttcttctgtgcaccagccctgacagacatcactaatcgattacagcactgccttgcactgagtcccctgggacctcataatctttcccaacatagggttaaggcagccaccaattaatcagagctgtctcccaaaatgaaatctatttgctgtagtgatccaggtggcaatctatttattttaagccaaactaaaatgttacatattaaaaaccttattattaagctggggacacaatattatagatgtaaggagacagatttgccctactctctgttcatgccttttcaactgtttgggattctgacacataccatagaaaagcaccttggatcaaacaacacaaaaaatcagagaggtagagattctagtacatataatatactggtagaattaaagctgtccttaggaaagtcctcactgtcttctagagcaggggttggcaaactttttctgccaagggccagacagtaaaatttcggcctttgtggtccatatggcctgtgttgcaactcctcaattctttcctatgaaaacagctacagacaaatgaatgggcatggctgcattctaatgaaactatgcataaaaacaagtggcgagagggatccaggtttggcccacagaccatagttggccaaccagtgttctagatattctatcttcagtccagatctctgtaggggcctttttactctttgttttcacctacctttagatttttaaagccatttctagccccacctgagcatcaccttcctctctccgcaaaaatcctgtggacccagatatagctgaatgaagacctggcacagaaggcagaactccaagcagaaggtggagtgaggcagaaagaaagaatccaagagcacagaaatgctgtggggagagggagcagggggtggaatgtagagttagaactaaaagccaagaactaaggctttctcctagtgggaacctgaaagatggatcagcagagtaggggagtcactcctcaatttctacccacccacagaagctggatgctttaaaatataggattcaaatccattcaaaatgaaccctgtgtggatatactcttggattccctgtgtgagcttgatctgactaggggccagtttggttatagtatgcactaccttgctaaggacagtacagagaattatatcctcacatctctctgaagactggtgcaaagtagcttcaaagcttaaacaaggttatttaatctgttgccacttccaacaaactgctcaaacacaattatatacagcagggtaagcatggagcaggttgagccagaagaaacaaagagcaggatatgtttgtatagagaatggatctatttagtgttaccagatcctaaagctggaggcagattctcgtgcaaaatggggatgagagttaagccagggtaagacaacggagggcattgaatgtcccaataaatatctcagagttataccttgcattcaatggcagggttattgaacatcttaggtacggcagttatgagaaagtatagagagtaactcaaaacagaatcagggcttgaggcagagggattggtcaggaagccactgcataatctaagcaagagaagatgaagatcagaacaaagtcagggtatgaaagggatgaggaggaggttgcagattcaagaaatatttagaggctaaaatcagcaggacccagtgagcaattagatgtgagaacaggggtatgttggagacagaaaggaactaagggtggctcagatttctgtcctggacaactgggcagatgcctggaccatgtccctgtgaagccagaccaagccataccccaatatgatcttccaaattacagtgagaactacgcacccagcaaacaggaaatctggaaaaagttccaagaagaaaagatttaaagacaaaaccaagtttggaaatatcccagtaacaagtactggaaatcataattacagacgcataaataaaaggccagcagagacaaacgaccatatgatgctactattaaagctggctttactgtacacggtagtatttctactgtgtttcaatgttttgcctgtaaaatacacaaagctataaaatgtatatcacatgtgtgtctgtgtgttttacaaccaggccatgccttagatgaacaccttctgtcctgtagtatttcattagacacagcacttttaaacaatggagggaattttagcaagtacatatttccaatgacccacccagaaaagagatttgagtgggtgggcacccatttactatttaggtttatgaattattattatttctacaacttttaaaatattttcaagttgtcttaaatagtgtatacatcattaaatagatgtcaaatgattatgggaaaatgacatggaattgttgaagatttgaagcactaccagtcatgggtaactaaatttaaaaagacatgtaggatagaaaaagacaaaaatgaacagcaaaacgtccagaagcttggaaaaatatgttcccatggagtaaattcaaggtctacatgctgtgcctaaattcaaaccaagacctagcatgctggcttctacattccacctgctgccctaacagagcttgttttttgttttttgtttttaaaaaaaaaaaaactaaaagatcgaagtcctacaccttgaaggacacacaaagattttatatcatttatcaaggattgaaataaataatattcagaaacaggctcctggtcttccagtttcacctgtgaaatgtacctatgttccatggactacagaacagttgaacacaagtaagatccgggtttgaatcttgggtctgtcactagcaaactgcattccgtggaataaggcatcctcctttatcaccttctgtctctacatctgaaaaattaggaggtgaactcgagcatcatggcctcttcctgccaggtcctccagccaggcagcccctggagagtcctccacagcactccacaagtttttcattaatttcctatttcaggtctctgtggctggaaggcaaatctatgaagatgggggtcatgtaatcttcttgacttcagaatacccaatgcataatacagttcctggcactcaggaggagctcaataaatatttttaaagtaactgccttcaagtaacttccaaaggctttttttaattcatttgtttttgtgcagttagttactagcaatgccagaaataaaattcagatccctgatactgccctgagagtggagggcaaatcagttctaagttggacccctgtccattctgtttttgctatcagatcatttggggacttgcctcattagaagctttcccagtaactggttgcttgcccatctgaaggtccacattcctaaactgttccccagagcctcctgtttcttccaaaaggaaacataaaccctatttaggtttgtcttagattttacattaacaaccataaagagactgatcatgaaatggcacatactaggaaagttgcaaaggtaagcagaatctcagggtaacttctcaaaattaagccttgtcccactcaattcttctccttccctaaaaatccctagggaatgatccatcccacaaagttgcaccatccttttgtttttttgctttttatggcagggggtgtttgtactttttacatttttattttcaatttttgtgggtgcacagatgtatatatttatggggtatatgagatattttgatataggcacacaatgtgcaataatcacatcagagtaaatgaggtatctatcacctcaagcatttatcctttctttgtattacaaataattctattctattcttttagttattttaaaacatacaataaattattgttgactctagtcatcctgtcgtgttatcaaatactagatcttattcatcctatctaactatatttttgtaccagttaaccatccccactccccgactccaaccccagtacccttcccagcctctggtaaccatccttctactctctatctccatgagtttcactgttttaattttttttagctcccacaaataagtgagaacatgagaagttggtctttctgtgcctggcttattttacatcacataactacctctagttccacccatgttgttgcaaatgacaggatctcattctgtgttatggctgaatggtactccattgtgtatatgtatcacattttctttatccactcatctgttgatagacacttaggttccttccaaatcttggctattgtgaatagtactgcagtaaacatagtagtgtagatatctctttgatatatggatttcctttcttttgggtatatacctagcagtaagattgctgcattgtatggtagttccatttttagttttttaaggaacctccaaactgttctccatagtggttgtacatagtggttacactcctaccaacagtgcgtaagtcttcccttttctcacatccttcccagcatttgttattgcctgtcttttggataaaagccattttagccaggataagatgatatctccttgtagttttgctttgcctttctctgatgatcaataatgttgagtacttttttcatatacctgtttgccatttgtatgtcttcttttgagaaatgtctattcacgtcttttgcccattttttaatcgaattattcaatttttttcttatagagttgttagagctccttatatattctggttatcaatcccttttcagatggatagtttgcaaatatttcccattctgtaggctgtctcttcactttgttgattgtttcccttgtgtgtagaagctttttaacttgatgtaatcccacttgtccatttttatttagatgcctgtgcttgtggggtattactcaagaaatctttgcccagtccaatgtcctggagagtttccccagtgttttcttttaggagagtcatagtttgacaacttagatttaagtcttttctacattttgatttgatttttgtatatggcagagactgggggctagtttcattcttctgtatatggatgtccagttttcccagcaccatttactgaagagactgtcctttccccaatgtatcattcttggcaactttgttgaaaacgagttcactgtagatgtctggatctatttccaggttctctattctgttctattggtccatgtatctctttttatgccagaaccatactgttttggttactatccaccattgctttgttcctgccatggggagttaacctctttggtggggagtactccccatctccttgaccaagatccctcttcctcagccagtagagagaggctcccagtttgaaccttctctcaatttttctatctactgattgctgggtcccctcccctaagccacagggactgggaaaatagctgttgactccttcagaggaggagctccagaagagtgtaaacagagagctccccctaaaacttcctgctcagcactgccatcctgatgtccactgtctctgagtctccagaagagactccctcacaatggcagaagtaaggggctctgagccagccacacccctcacaggtactgccctgcccttctcaatttctccaagcagcttcctcttacctgctagccctggctgagttcaagttttgtatatttttttctcttgacttttgatcttccttgcatgcccacttttatttcattcctgttcttccaatgggaaaaatttgaagcttgctttcaaataaggaaagaaaaaagtggacaaagctaagttataatatatagggataggcaaatggataataaaaattacaaaggaaggtgatataatttgtatttgtgtccccacccaaatcacgtgtctgactgtaatccccagtgttgaaggaagggcctagtgggaggggactggatcatgggaacggacttcccccttgctgttcttgtgataatgagttctcaggagatctgcttgtttaaaagtgtgtagcactgtccccttcgctctcttccttctgctgcagccatataagaagacatgcctgcgttcccttccccttctgccatgattgaagatttcttgaggcctcctcagccatgcttcctgtacagcctgtggaactgtgaggcaattaaacttcttttatttataaattactcagtcttggctggacaccatggctcatgcctgtaatccagcactttggaaggccaaggcacgtagatcacttgaggtcaggaattcgagaccagcctggccaacatggtgaaacccaatctcaacaaaaaatataaaaattagccaggcatagtggtgggcacctgtaatcccagccacttgggaggctgaggcaggagaattgcttgaccctgggaggcagaggacgcagtgagctgagatggcaccactgcactccagcctgggtgacagagtgagactccgtctcaagaaaataaataaataaataaataaataaataacccagtctcaggtagttttttacagcaatgcaagaacagactaatacagaaagtaaggcagagattaccacagaagtcaggagagtggttattcttgaaatcaaaacagcatggtactggtaccaaaacagagatatagatcaatggaacagaacagaggcctcagaaataacaccacacatctacaaccatctgatctttgacaaacctgataaaaacaagcaatggggaaaggagtccctatttaataaatggtgttgggaaaacgggctagccatatgcagaaaactgaaactggaccccttccttacaccttataaaaaaattagctcaagatggattaaagagttaaacgtaagatctaaaaccataaaaaccctagaagaaaaccttggcaatactattcaggacataggcatgggcaaagccttcatgactaaaacaccaaaagcaatggcgacaaaagccaaaattgacaaatgggatctaattaaactaaagagcttttgcacagcaaaagaaactaccatcacagtgaacaggcaacctacagaatgggagaaaatttttgcaatctatccatctgacaaagggctaatatccagaatctacaaagaacttaaacaaatttacaggaaaaaaaacaaccccaacaaaatgtgggtgaaggatatgaacagacacttctcaaaagaagacatttatgcggccaacaagaatattaaaaaaggcttatcatcactggtcattagagaaatgcaaatcaaaaccacaatgagataacatctcatgccagttagaatggcgatcattaaaaagtcaggaaacaacagatgctggagaggacatggagaaatagggaggcttttacactgttggtgagagtgtaaattagttcaaccattgtggaagacagtgtggcaattcctcaaggatctagaacctgaaataacatttgacccagcaatcccattactgggtgtatacccaaaggattataaatcattccactataaagacacctgcacatgtatgtttattccagcactgttcacaatagcaaagacttggaaccaacccaaatgcccatcagtgatagactggataaagaaaacatggcacatatacactatggaatactatgcagccataaaaaagaatgagttcatgtccttttcagggacatggatgaagctggaaacgatcattctcagcaaactaacacaggaacagaaaaccaaacagcacatgttctcattcataaatgcaaattgaacaatgagaacacatggacacagggaggggaacaccacacactggggcctgtcggggtgtggggggctaggggagggatagcattaggaaaaatacttaatgtagatgatgggttgatgggtgcagcaaaccagcatggcacatgtatacctatgtaataaacctgcatgttctgcacatgtatcccagaacttaaagtataatttaaaaaaaaaaagaaaggaggaagtggtgtggtttgagcaagacctcttggagaggttctggggtaactaaaaagttctaggtccttacatgagtgttggctcaaaggtgttcatcttataaaaatcatttgctgtgcatgtgcttaagctgttttctgcatttgtactgtacttaaaatttttacttcttttttcaactctcatcatcttggattctataacttaactatggaataacgatcaactggatttgtgtagaatttgttctgtaaatagagaacctaacaagtctcctcccatgttttcataagttctcattgctgcaataaatatttcatatccaacttccatttgcttgtctctattcatgaatcaaagcagatctgcttgaagacagacagtatgtctaagtaaggaaagctaggctagagaaaagcttccatgatggataacctagggtctaaaaggcctgagtagtcactaaaaatataatgcctctttccttttatgtctgttaaagtattttaaagaatttctatgtaccgagaagaactttaaagcagatgaaggcaataatgatgttattattatgacatctattgctattgcttgcctggggctaagtatttaatgcacttcatcaaatttaatctttataacaaccctaagagatggatatcatgttttcttagtaattctgcctggttcatactgttatgaacaggctgtgctcgttctcacctctggacctttgtacatgctgtttcctttacctgaaatgcactgcccccaaatatttgcatggctggcttctgctctgccttcagatcttagcttgaatactgcacactcctcatttcacaatcatccctcttttcctttctggtaccccttaaaatatattcccaatacattcaccactcataaaagcaagtgtccagtgggattctttattccttgacagaactatagtaaaatcttccaaaagtaacagatgactctgatgactgagccatcctggaaatttttttcagcgaatactcagctagaatgaggcaaactatcttgagatacttaccttttaataaggagccatgaaaaaaagaaggcaattaatacataggtctggccagcaaaaatggtattgttaattactttgaagaataaagaaagcactgggcgtggtagctcacgcctgtaattgcaacactttcggaggccaaggtgggtggatcacttgaggtcaggagtttgagaccagcctagccaacaaggtgaaaccttgcctctactaaaactacaaaaattaaccaggcatggtggtgagtgcctgtaatcccacctactcgagaggctgaggcaggagaatagcttgaacctgggaggtggaggctgcagtgagtagagatcgcgccactgcactccaacctgggtgaaagagcaagactttgtctcaaaaaaaaaaaaaagagagagaataaagaaagtaaccatgcccaatctcaaatgccaacctttaggcttagaagtgagaaagcctaccctctgtgcaaaaatgaaaccaaagaaaagaatcttaaattctcattgaaacagctgtacatgggttttggcaagtcaagttttaattgcaaaatttaagcaacaataaagatagcaaacacaattcttcagccatgagaagaaagaataacgatacctgtatgcacttaaaccaacagggaagtatacagtgtttctaaaatttatttcatggctaaaatttgtgtttagcttggttttgtggctgcctttgcagcctatatgtgcagggctatataaatactcttcagggatcctgcctccccatagcatcaatcaaattaaccaagtagccgtcaaagtccgtttggagagctctatgtggctcaaaccaactgcaggcaaaccgcgtggccacaggagccgtgccatttcctcctcagtcacctcactcctgtggcctctggactggagacggtgtccagcctctcgatttacaggaaccctttgcccacctccagtgcgtgggtatgcaaggccatatttagctcaacctacgcatagttcactttgcccaaccaggtgaagccagacaccaagtgagcacaaagaagaaagggctttctgtctcaagtatctgtctgtgtgaagtcagtggccactttggtgcctatgtgtcaaattctttgggtttttaatttagaggtggaaaatacagccatctaactctagcaagcaaaattaaggaggccatgatgtttcatggcaagaaaataaaaccatttgaaaatggatatgcatatgtgtatatatatctatatacgcgcatatataccatatgtgcatgtgtgctcaatgagggtatggctagctgccaaacattaagaaaagttctaaaaatttatgatgctgggaaaaagtatacaaagacataaatcttgcatttttctcccagtcagtgcaaaagtatcagaacaggcatgcaaatcttcaatacagtttaaccctaagagtttcgagttaaaacatatcagaatatgactgaatatttggtcaatgctaggtgtagtaatgataatgatgacaacagtaattgtgactgtcatttccagagtacactcccatgcataaagaactgtgacaatgactttacattgagaagtcattgattcatacaaactgatgaggtagctagtcttcttatccccattttaaagataagaaaactgaggcatagcaagagtaagcaatctcaaaatcacacagctgtgaagtgctagaagaaggaatggattccaggcctacgtaactctagattgaagaatgaaaagagatggccactgacatgcagcctcccttctgaaatggggaatggaaaagaaacaacatccagatctagacaaagaaaaaaaattgggaagaactcaggaaatttctggataatttaggcctttaaggaatcaacatcatccacaatgtctacataattttggcaatatgaagtctttttgtgattacaaatgactttgaattttctgcagtatagaaggagccatttgaaaagttcaaaacccaatcagtatattatttatatgatgcttaaaaattagcttgcttcatttcaaataaaaaaatcatgcggtctgggggaaaaaaagataaggttacaaaacatgccagactgttcccatctctgtgcacataatccccattctaagcagtgaccttggaggctgtgacctactccaaagatgtagcctttactccatgacattttgggaaacagctttggaaccatcttcagagttaggcacagtaccctgccagaagcataactttatagccacatgttttttagaaccaagtctggagaataaggctgctgatcaaaataggaaatgctgggttttaggtaagaacatgtgattacaaaagagtatgatctcttgcatggctttcaaggtggccagaggagttccagaaagcttttgagtaatagtcgccatgctgggaagtgaataccagttccacggggtgatagctgagaaggaaaacattcatttgaaatgtgagtgccaaaaactagactattgaagatggtggctgtgacgtagtcctagtgcttacacaggtttagtgttccctgcatggagcccggcacacagcaggtgaccactgtgcatttgctgaatagctcaattactccatccatctgtcaattagacaatgaacaaactcttggctagtgagaaaattccttgctcacataagtgctattggccaagatctaaacactcagaaaaagtatggcttcacttagagaaccaaagtatgaagaaaaagttgctctgagaacctgctggctcattttgccacctttctgaaaatttttccagtctgcaggccatgtgccctacatgtgtgcatacagggtgcctgccacacaaggccattgctctgaggacagggtggaaattaggtttcctctggcccctttgttacgctgccctccctgctctccagacagccattccaagcagcttctaatgaggaaggtgccctctgcaacttcaaggagaaatgaaaaacagctagggtagctcaacaataatgcacatcttcaaatgccaacaagaatgcctcttgcagaaaatctctgttcaaacaaacttcatgacaaaatctaaatagtgcattctttattcatggttagcctatctgattattcagttattcatgcatctcattttatgaataattaatagtaattatcttattacctatcaggcactgaaaagacacaggtcctcacttcgaaggaggtctccattgagtctcaggcagaacacacactcctgctctctcccgagccccctgcatgggctgattggcgttggcactcttctcttccctcacagatacagcctcagtccttctctcctgcatgctgagaagccactaccaatcctcagagctgctatggaagcttatttgcaactctgctcacttataataactcatgtattcagttagtcaaaaagtatttattgaatgtctaccaagggccaactctgttttggatacgtaagatagtcctacattctaggaggagggatgatggacaaagtgcctatgtgctcatgggaaagacagataagtatacaaataactgtacattattattttaggctgtgatataagtgatgaagaaaaataaagacagaaacataaagaaagacaagaactattaattagaaagagcattcagagaaagcctgtctgagaaaacgacatggcagcagaaacctacatgaaatgaagaagtaactcacacacatacctgaagaaagaaccttctagctaagggaccagcttgttccaagggcagggagggtttggagactggagtgctggagcagtcagtgagggaaacaatgggaggacaacagggggtcccaaagagagccagggccaatggcacagggtgctataggctatggtaagtaaggtctttacagagccctcaccagtgtaaatgctgaaaaacaacatgacatcatcagcatcctagcaacatcatcacggcatcaacctgcatttactctgtgccggatgctgttttctaaatgaccacacaacactaggaggcaagtactaccatcacccgaaacttatcaaccttgttgcacaacacacagctagtaagtgacagcatcgggagtcaacacagaagccaatgatcttaacccacgtggtaaaaacatcccttagaaaagcaattacaggccgggcacagtggctcacgcctgtaattccagcattttgggaggccaagtggggcagatcacttgacatcaggagtttgagaccagcctggccaacatggtgaaaccttgtctctactaaaaatacaaaaattagccagttagtagatgagccaggctcaggcctctaatcccagctacttggaagtctgagacaggcgaatcacttgaacctgggaggcggaggttgcagtgagccaagatcacactactgcactctagcctgggtgacagagtgagactccgtctcaaaaacaaaacaaaacaaaaaagcaattacagcccggcctggtaaagagataaaaaacattcacacctactcaaaacctgtaaaacaagctaatgatctgagtagatggctgtggctttgttcaagactccagctacttggtcacacatgggttcctaaggtactggggtcaaacctctcagaggggaagataaggtgcagggaaggctgcaccagatgatggaaaagcacctccaggggggtcactgactgttaggcagaggaggcttgtggagagttcaggtgacattgttccatgaaatacaagagtaaaaaaaagcacatgttgtgtaataaatgattttgaatgtaactaaactgataatataaatgtcataagtagacatcttgattattttatctatatctctgtaagtttctatattgaaacttgaaaatttatctttgagaaatagtagatgagtttgtattcagggtggcttatgtttgggtacatgagattatatttactgactcataaatgacgggaagaagtggtcatcagagccagggatagaggcctagctcttagcctagaaacacatgcagggagccccagcaatgctgcaggagctgacttgggtggaaaaactcaagctgcctttacttagaaggttcatgttttaaacttgtagtgctgcttagtccaatctaccaaaaagccctacgcccacatttcctagtatgtcttatgattaggtcttcatggttctgtctgtccattagacagggcatgagagagaagcaagaacccagcctcgaaaaaccaagaggttctttcagagcccaacatgatgcctgtggaatgaatgaatagattaaaactttcatttcagaagcatttaaaatatagagctatgtccttatttttatatgggaaacaataagctttgagaattaaaaacattacagaaaagaatgtccttgcccaactgccatatatctcccagacttcatagctaactatgatctcattctaactactaccctggtctcaaccactggactctaacgtacatgtggtaattcctgtgaagtgaaactttattctggtgaaccaagcaacagtcaagaacgaccttaatctctcatttccactaggaggaaaataaccttgcaagatgagtaaaaggtaaagccgtcattaagtcaggttaagagaggtgcagttcattcagaaatcacaggcccatgtctgaacagacccaggcatctaggagatgtacactcaaggttatattgtttaacagttaacatttttaaatgtgcggttttctaatttcttataaggatcctttcacagccaaaaaagtacaaccaaaataaaaacaagtctgctggtaatgacacagggacgctctgtgcttcattttcaacccgtataattgactttgacagcataacatgagcctagagcactatattccatattgccttagcagaaaaaaaggtaaaattgcatccaagttacaattaacaatggatacttaaaaatttcaattttatattttaaacctggaaatatttccacaccttcccccaaaacagtcatcaatttttttaaaaaaaatttatcagatttggatttggagtatagcataatgtgaacttgtaattagaaatcaatgtggattctgggatcaagaaataatagatgaaaatattactgtacctttcataaacatttttcaatttgcttcatatcagttttcttaatgaggtacaattttttaaaagtacattagaattagaattttcttggttaatcattataacagagctgtttttcaacaaagtggcaggggcaatccaggtgaattttgattcagcaaagacaatattatgcttaataaagtatcaccgcagaatttgaccaacctcaaactctaatccaagaagtaattgcatatgtcagttatcatcagtaagaattgcctaaatcggcatttgcccaagttccataaaatgctaatactttgcaatgttaataaatgccctagtgggaaagaaaagggctccctttgtcaagtgatttagagaaattctggattgaagaatatcaaacatttcttttgactgcaggacttctcagagcctttaacatgttaatatgcacagtattcttaacctaaaagaatatgtattattttccagaggcatttgacaaatgaaaccccttttccttatagtattccatagaaccatcactctgataaacatgttttgtgaaatgtgaatctagattatatcaaccctcttttagtcaaattagtctctattctattttcccacagctcactatgacctgaacaattaggagaaaaatagcccctgctgacatagtggcttattaaaacaataatctacttcacaaacaattacattttaaagccacatagttccttcccttgagaaatgtctgtaagccaggtggctcaattctgagaagttcctgcactgtgtatcttgtgtccagactgtcagagttctaatccatcttgcaccaaaaaagtaacaattggtggatgtattattataaccgattgctctaaagaaaacaaaatgtgttagtgcacactatgaaattctcaaaatggcagaccctgcactccagatggaaaacagagttcttagagtgacttacatttaaagccaggtattctatattaccaggatggtgccaagaagactgacttccctagattcccaatgggaggacatccctgctcctgacctgcatgttctattttggcagcagcctcactagttggcccatgagcctcccctgcttggaaggtgcttttaaatcaccacatatgtgcacccttcaattagtccccagaccccaggatttcagagttgaaagggccttacttcaatacaagcccctcttttgtagatgagaaaactgaggcttagagaaaaaaaaatcactcgagcctagactaaaacccagatcccctcacttcctgcttgatacattcgtctctcacccactcagaagctcagggccccacggatgacctgaggtccaaaaggccttccagaagcttctgttctagcatgcaagagccaagagtccagctgcagccacaacttcattgttacctctttcaaatactcttctgtctcagagcacgcagcagcccagtaatgcatgttctggtttactttcagaagctactgcaaatcaaatgctggggggaggacatctttagtcagaagaaaagatcttgagatattcaaatgtaaggaattttgtcttacttgttgttacatctcagtaggttgcacagtgcctagcacacaaaaaagtcctcaaaaaacatcattgggaatgcttgatgaactgaaggcagagtcttacacacatttaagaagcatttaagtctaactcactacttaaaataaagcttaatccgtttccataaaatccatgcaaaaccccgttacccaagtttatgccacctaatttttctatgtttttggaggggcctgaccagcatcttcactgttgatacagttactgtgcccaataaaaggcatgcaaagaaacagttccactcaggagaaagaaaggtgtccagtttatgactgagacctgagaaacagcatcggctctttctcttgcttaaattaacatcactaagtctcaatcttcttatctgtaaagtggtttcaaagatagtaacatcttcattagtttgttgggacaattaaacaattcattgtgtgtacacagcaacttggccaactatgattgctttttttaatggctgctaatattgaaaagaattattaagctgggtgggtaagacttgtcttgggatcagttgcgtgtacctgccatgggtgtcaatgaagagggtgcaacagacacatcaggtgtttgctgtacatgtagatgcactgccctgatgccccttcaggaccaagacagtctccaagtgccagggatgtgctttccctgagagctgccttgtctaagattacacccttctcctggcattgcccacctctattgactcaattagagtcaacagccctccaaatggctatctcagctccagagcaactgatagggactgctacggcctttgctgcaactacattacagtttgacttttccctgtgcctaatcccacttccctccctttctgagagcaccctcaataaacttcttgcatgttcatctcagagtctcaatttcccagggaacacaactgaagacattatccttggcctacttcattgctcaataaaaagcagctattattcttttggttgaattttctaaaatatccacacttgttttccatcacaagagacttcctgactctctttatgggtgacatcctttcatggatggagaaaaatggcaaagatataaataacttaaactaatttttatttattatctaaagagtcctaaactctgtactctgttctcacagtaattatctccaccaccgatttactacttctttagttaccctagttttaaagacataagagaggcacaggaaatgatagaatatcctgttataaaatatacataaagcttagtttattcacaataactaactaattttatataattttagatgctcaatctaatacccaatgctgaggggcacaagccttaggtataagcttgaagattttaaccattcaaatcctatcaaaggtagtcttaccttatggaaccagtgggttgcacaaatggcactgggcaaggatgcagaaggcttgggatctggtctcccctctgccaataactccctctaggatcgtgggcaggtcatttgcctttgctgggccctacttccttcatcggcaaaacaaggagcttgtattaaatgaagtctaaggtcctttctttttttttttttttttttttttttttttttttttttgttgagacggagtctcgctctgtcgcccaggctggagtgcagtggcgggatctcggctcactgcaagctccgcctcccgggttcacgccattctcctacctcagcctcccaagtagctgggactacaggcgcccgccactacgcccggctaatttttttttttttttgtatttttagtagagacggggtttcaccgttttagccgggatggtctcgatctcctgacctcgtgatccgcccgcctcggcctcccaaagtgctgggattacaggcgtgagccaccgcgcccggcccgtctaaggtcctttctagtaagaaaaacttatgattgctcaaaccttgtagggctttttccaggcaacataaataagatgtagagggaaagtgtaatagcagagaagaaattaaaagtgtcataaattcaagttaccaacttcccaaatgtgtattacaggacagacgattaagtgaataggaactgatttaatagttgtattttccttttgcaagatttccatctaaatcattgcctatgtcattgattgtcatttccttaatctggagtgtttgaatatatagtttggcaatgctttggacaagccataagtcaaagttaacatttttagaagttaaccatgcccaggtctctgccttgggcagtgatgtgctgaaataccagcatctatttgagctattggaaagaggttattgatgtcagtgtgtcatgcactgtaatttgcaggtgcccccctgactaacctctggtagcgataactcagggtaaacctgaggtaattatcctggccagggagagctggtttaactagactggcccttttgatgcatgttgaacacgattgcaccctagggattacacaagtcctgtgtgtgagttattacataaattctaccttggaaaaagtaagaaggtatgctgtcagaatttttttcttctcccagtccttttgctttcaatgtttgggttcttcagtaatgccttcaccgtatttactttgaaaatgatactgcacgtgttatggagtaaaatagaatagaagaagatatagatgctcccaaacacacacctcagaggtctcccttcccagtggcttttgaagcatgattctggttccgagtcttttgcctgaggaagcgttttttttttcagtgtacgaaacctgaggcttggtctaatcttcacaggaagaactctcaagcttttggtacctccttaaggctttatcttcaatgagactcacgactgcagaccagtcactgaacaattgtctgactctcagtttcctcatctataaaataaagatagataaactggtcctaccaatcctcaaggccagaaaaaggatccagcatgaagatcaccccacgaaagcattttagaaagcacacaggactctggcttagatgggcttgttttattattgactaaacgaatcatcagcagtggttttaatgaacatacaaaaatggggtctccagtttatagtccaagcttcacctcaaaataagcccatagatcagagtcaggggtaaacagaggcaagacagactctacaagcccagccctcctctctctctagaactgagcatagcatttcttttaggaaaggatccacgtctgcttctagttttcactggagctcacaaaaggatgacacttattgattttcccttattgatttctatttcagggaccaaaagccacaaaataggataacgtctaaaaaatagtgtgagtttgcttagaaagccccctcaaaataaataagagatgactataccattcaagcaagatttctttttccaaaacccccaccccaaggcttgtcatttcaaactctacccccataataacaatgattacatttgagaaatatgttgcgtttcattcagcaggatcttcagccttcggcaaacaaacattcactttgccaaggactgctgaagagccactaatggagtgaaacctgaaaaccctttggaaaagaataatgaaccccactctgtcttcagggggtaatttagtaggtagcttaggcaacacttgattaagagtaaacctctcttttccatagaaatatattgtgtttgtacagaaagcctatatgaagtggaggattaggtcagaaatccacaggaaaaagcagaagatgtttctcagaagaaatatgcaagttactgcacatttggaaaaacaagtcatactttagtgggaggaaagaagaaaaactccacatataacagttttatttacacgattgcacttggcttcttggaacatttctaacaaatagttagttcccaaatacattgcacaggatgtcttgttgcccctgacagtctatgagttactacaaagagtaatgattttaactcaaggctacctgaaactgattgtcaaataagattttctgagaccgcctacaggggcctgctatagcaaaagtcgtttttttggctcgcggaggattatagtgtgaaagaaaaacaaatgtcaaaataaatccccaaggaaagaaagcacttctgtgctgaccctcagtcctactcgtcaacattccttgtcctctgtagactaacaaatacttgagtatttctcttcgtctgaaaccatgaacagagtctgaaaaaattagatgagggtcagttcatatttcaacaatgtgataggatttatccataacttaatggaacttcccaatctctacccatcaaggtagaaaactgcaaaacaaataaataaaacacttcacagcattaaaaacaaatcatgatgttaaattctaataaaaatttaaacaaatgtggattctcttttaaacctgggttaggatgacctttctcatcttttccatatgttgaaaatgatggctgaaatgaagcctccctaaatcactctacaccatgcctaccaaacagccatggaaaactaggaactaaataaactcattttgacaatgatgaatctcttaactctgctggtcaggtttcttctaatggcagtacttaggtaagtgtaccataacacatgaacatagatcacatttaaagtaacaattttaagctcagggaattgaaaaagaaatgaatttaacttagtggcttggagagatgaacatttagatatgaagcttaaaaaattgctgcttaagatatacacgtccttctgcaaagaaacaacttagcaaaccttgggaactccataatgaactatatgttttgctgaaagctatgcatttttgaggtttatgttgtttgttacacttcctctgttagctgattccaactctaattggaggaggaaagtaaaggaagtccccttcgaaaaaagatattggctgtacagggttgcacaaattaaaaaataaaattgcctttctagcttttttttttagaattctattaaaaggacaagaataaatgagaacattcatttgctttttaaaatgatcacacttgggtttaaccacgggcagagaagaaactttacggttccctgggaacctataatttggaaacggaagcacacaagaacagactttagttttcaggcaataaattgaagagaattctgcagacatataacagaaaaggagcacaaaacattggcttgtacattttttagaaagttagtttattaactcgataagctacacatagaaaaatgcagccaaaatctacaaggatatccactggggtttcaaattggtatatttactcagtgagaaatagctagagctttaaaaagaaaaaaataaataaaaataaaaaaataaaaaaaaaaggcatcccattctggaaatgacgatttagtgtgaatctctggaaagacaccttgttgaaaaacctccatgtgggctctgatgggacacacagaagcccaaagccccaaggtcagacataaatatcatgcccaataatctgtgttctgggaaaagctctacagaattatacaagaaaatcacgatctttcacatccacctttcacacacaattcaacattaacttgaagaatgttttaattttcctccttattgcccaaaatgtttttttaatgctttattgggaatttccatttactggtgtgtgttctatatctgtattactcatcagtgtaaaatagttgcaaagaatttgttggttgatactcccaatggtcactgtcttctatgactaaaagctcattatcagtctctctgggagaaaactctagtaactgaagtccacatatgtcaggtactgtgctagattctttcataaaccttattttatttaacctgcccagggaggtaaagattgtaatccccatttacagatgaaaaaagtaagggtcagagagattctctgccatactcaaggccctaagctaataataataagggccagtatttgaacactggccagttcaactccacggttctgcatccttcccttcctgttctccttgtcaatgctccaaaaaaaatgatttgagaagctaaatcaagaacattccctattcctgtagatagtggtgatttcctctgagaaacaataattcaaggtatcttcaaacaaaattgggactcagaacaaatactaaactgccacctctttccaatgagtcaagttcggctaactagggtgtattcttagtcactttatttacacaatgtagacccactgggatcagagtgccaggccatgcagcagaggccgcaagccaatgggcaactcatgtgcacatgtgcttcacaggatcccagagtgtttaaaaattcaactaactttctaaaatctatagatttcacatacaaattcccattttatggactgtcttggataatcggaggtcccatcaccctaggcccacctttacagcagtgttcaaccagagcttagtggccactactcccatagatgagtaagggttcttgagttccctatagctccccaccaccctcaactatatccacacactaaggccacctacagctgaaatttttcattatgcatatgctatttttcttataatagagaaatatttctccagggcttgtctcttttgatagactgaatgattggcctcagttctccacctctcctcgtatctactcccgtacatttttgtctttgtgagtcaagtgaacttttccaatctgtgacttggtcatgtgctttgctttgggccaatgccaagggtgaaaatcacaatatcagttcaagagtaggccttatgaggcctagtatgtttttgctcattctcttgtgcttcagcaactgtcattagttttccctgggttgctgacacctggcctcagaatgaacacgtgtaacagagctgccccaggcaccacgacagatgtgcagtgagtagaagtgcccagccaaacccaccctagagcagctgggccagttagtcaacctgcaaatctgtaagaataaactattggtactaaaaagccactgcgttttgggtgatttgttgcacagcacagcattattatggcaattgctaactgacacatctctaccaaaaataaacaataaaaaacaggcagaaagaaccagacatcattatttttcctacacacaagcctgtttcttatgttaaaagcctagaccctgaagacatttgagtttgcaatttctgtcggaaaactgtaaacttatgaaataaagaagactggatttgtaaaatatttcgtactgtgctatatatccaggtttgactgaggtgacgcaggttttgtctattgccttttgtgttctggtttgaacaataaaaagcatagtcactctatcttcattcaactttgtttccgactttcataccaactagttgaatctcttggtgctcttctttgaagcctgatccactagctattattgttgtaggcaatactctacatgatatttttctggatataatacctgttgggttggttgaaatcatgaagccagtgtatccaattgttaccaaatgcttgtgtagaataaatcaaaattaacaggtgccaatgccacaaccaccaaccagccaagctaaatcctggctgactgacacttaaagcttaacaggctaacttgtaaacaggaaatgctcaaaacaatagcaatattaaaaaaggcaagtgcctccagaaagttttggcagtaattactacatctgagcacatctgcttaacaatccaggaaagtgggaggtttactctctattaaccttaaccagagacattttcatcaaaattaatcgtgattactttttattgcatttcaaatgctatcctttatttggggtggtcaggaatgcaactaagcaattccagaccatgctatcttttatgaagaggttatgaggtagttatcaaggcctcttatgaaaatattgctatacaaaagttcatgggccaaaacaagacattaatttccataactatatgtgtcctcagaaaagaagaaattactatatatagaaaagacaaaaactttgatgctcattgtatatcagattagaactgtagaaatacctctgcatatagtaaacaaatcgtttttaatgtttcatttgccttttccttgttattataacaaccattagtcatgaatgcttattttgggcatggtctgtacccaagtacaattctaaattatttatatgccttgactctttaactctcacaactactctggagcagatgcaattattatccttgttttacggaataatacaccatagcaaggtgagccctaaggtcaggtcgtctttaaagttctgggcccacctggacaggcgcagtggttcacacctgtaatcccagcactttgggaggccgaggcgggcggatcatgaggtcacgagatggagaccatcctggctaacacagtgaaaccccgtctctactaaaaatacaaaaaaaatagcggggcatggtggcgggagcctgtagtcccagctactcgggaggttgaggcacgagaatggtgtgaacccgggaggtggagcttgcagtgacccaagatcgcgccactgctctccagtctgggcgacagggggagactccatctcaaaaagaaaaaaaaaagttttgggcccacctactattgtctcactattcagtgaacactccaaatcaagcatcaatgtaaagggccttcagtgacaccagaaggcatgtctaggacacagagaaaggaaaaaaaaaatacctaatattgactaactagtcctcatgtgccatgctctatgcaaggtatttccttgtatttcctacactggaataattactgatttctcttttggccaattaaaaagatgaactatgagtacatattgaaattatctaacttctcctatctccaaggaggaaacctaatatataactggagaaagacactaattaataaccaaaatttaacatgaactccggccaacttgaactgctctgtttaaaggcacactggaataaataaagaaacttcaaagcaaatgccctgttttagcttgaatgttttattgagtacatggggagcactccttggccaaaaataagggtggttaatgaggaaaaattggtgtttccagtgagttggtttgtttctaagatatggctgtccattgaaagataactatattcacagagaagacagaataatgatctgtgtctgagcttcacagtcttgaacaaaacaaaactggttttgtaaactgtctgggatcagctgaatgtatcctcacccaaataccttctgtgataatacacacacatttgccttcttctattcccaaaacaatttaaatataaattgaaaaggaagacatttctatgttttaagtttcttgccaactatataaatgcagcccttaccttttaaggtgaggtacaggaaccaaaagactctgccttgtatttccaggctctaccgtaattggcttttcatggccaccattctgaaaatgatgaccctccctgggaaagacctactgggttccctgttagtgctagactcagggcaaaggcaaagtccaccatttctgtgcatattttctggcaccaatggtgacatttctgagagagtccatctctagttatttagcgattaagaagagaagcctgtgcttacctgcaaatgctgtgagttgtcagccatgctgtcttctcgcctgcgcacttcttctagtaactgagcatttttcttcttttccaactgttgattgtgcttgaggttggccaccttcttattctgatctttcatatgcctgagaaaagtcagcacagcttggttaaattctaccactggaagatcatatgttatcacaaatagattcaggaagtactaagtataggctatctggataagggcttgggaaaaagatgatacttctgaataatccattcattcaactacaaatatgtattgagcatccacttaataccaggtcccaggacggcactggggctgcagtggcaaatggggcaggtataatcttcactctcatggagcttagaggccagtgggcaagatggacaagtaccaaggaaacacaacttaggtttcttaacgttgaaggaaacaaatagcatgctgtgagagacagtgatgtgcatgtgtggacaggtggtggagtggaaggagatgactttagatgctgtggccagggaaagcctccctagcaaagtgagactgtgggtgagactacaaggagctaaccaagagaaacaccagtggcagagctcccaagtagagagaacaatgcgtgtaatttccaagacaggaaagaagaaactggaaggctgcagtgaggctaatccagggaagggtggatgtgggtgggagatgggactgcacaggtaggcagggcccaggctcatagggcctctggtccatgatacagcatttattttcttctaattggttgctgttctaattattattattattcttttggatcatgttcttattctgagatcataatccattactttgattttaaaataacaattatgaggctccaatcaaatacattgtcatcacttagctcaaacacaataacagtttggctaatcataatgttaaataaagctctggggcttggagtaaaacttcttaatgaatctacaggatgtcaaagtgcaaaatcataaagtgatcaagtgagtaaaagactaaagataaagaatgggttcaagaaaacaacaatgggaattataagcttaatgtgtactattgcaccagcagcttttagcaaaacattccacagatttaggcaaccatgtccacagcagctgtcataaatctaatccaacacatgaggaggtaggagggcagtacggagggctcgggagcattgacacaagaggagggacgagcagcagaatcatttggggtcctttcggatccctttcccccataccacagcattgccaggtcaaccactgttactgagccctgactcagtaaaaaacatactgagaatcactgctgttttaaaatgtaaacaagatgagaactagatgataaacagcaaacgtgaaattgaaacaattaaaatcaaatgaaaactgctctccgcaagaaactcttatttctagtcctcataaattatgtacccccctactctctcccattccaagcaaacgaagcacaagagcattgtttagttagtagaataatattatctagtactaacagtgtactccttgctaataaaaacagtccgagggtgcagcggctcatgcctgtagtcccagctactcggaagtctgaggcaggaggatcgcttgagcccaggagttagaccaccctgtgcaacatagcaaggccccatctctaaaacacacacacacacacacacacacacacacacacacacacacactctctctctctctctctctatatatatatatatatattctgaacactttgtcttcttatgaatatttacactaactgaagccatgatttaaatattattggtagcacttattaagaggacataaagtatgatataataaccatctccttagtctttgagttgcattaatttttgtccaatatttctccatttttacctgatacagcaacatacacacgtgaagccaccaagtcaaacttgcatgctaatccactttgaggaaattatcttttggttagtataaagatgttaagaatgccctcttgctttctaattgaatgaggacacagtatttccaaagcccatgctaacctaaggcaggcgcattttccagttccttaggaaataaggccagagctcagtaacaggatgttatggagaggtcaggatgattagtgtgattgtttaattagagggtacttttaaaaagaaataatcttattactttagaatacagtgttaaatagaaccaactgctaaaagtccccctgccccaagtatgggtgacaaatacagattattattacaaacatcatttgcacagtgaaagagctcccacaaagttcttggagcagtctgaacacagtgaccttactttcagggatactgcaatgttttttcaatcccaaagaaaaaagcatattctaaacccacgtgtcccttaaagctttcctgaattaagaaagagtggcggccgggcacggtggctcacacctgtaatcccagcactttgggaggccgaggtgggcagatcatgaggtcgggagatcgagaccatcctggctaacatggtgaaaccccatctctactaaaaatacaaacaaacaaacaaaaaaatagccaggcatggtggcaggcacctgtagtcccaggtactcgggaggctgaggcaggagaacggcgtgaacccgggaggcacaggttgcagtgagccaagatcacaccactgcactccagcctgggtgacagagtgaaactccatctcaaaaaaaaaaaaaaagaatgagtggctgagaaaaatggggtactctagttttgacattatgatggaggcctatctccagccattcctttaaacactcccttatttaagacaacagtgactgaaaatggaaagttgggttttgaatggcactgcttaggatttgggccaattagagagatgcagagcaaggtggatgagaatgatcatcttgtctttgttcatgaaactgtcaatagctacatatagtgtccacactctcctgaagtagttccacagttttcacacatatttctagcagttgaagcctttcttttacttaatgcttacttgaaagtcaaaagggaaaagaaggatttctctggcacaggtaggaaagaagcaagaagtggggtggaataggtgagcagagcctcactaccagataacccctctctcaagtgtttctcagggaagccctaaggctacctgaaacacatgttaaaatggcaatttataagggatacaggtagaggagtcatgaaatttaaaaatactagatctcttagagaagagaaaatgccctcacagatgctcagtgaaaaaatgaccacagtgatttttgctagcaacaacttcagcatttgtaagaataaaatctataagtgacctatcagtctccacatcttcccctacctgcagaagtacacccacactgaatgaatcaaagtgctaaattcagtacagctttcaaatgtctccacaatctagaaggtaaggcccctggtcgtggagactgcaatgccttcttactatcctgccccagaaccaagtatcactcttttccaaatccccatccacttggcaaggctctgcaagagactgacttgctccattatttaaaaaaaaaaaaaaaaaaaaaaaaaaaaaaaggtttctttggggtgaaatttttctccagaaaaaaaaaaacagcattacgaatacatgcaaaatgcaaatcttaaaaagataaaaacaattatggtaaaagaagtatttggaaaatatagtggtaaggttagttttcaatgtttaatttaaatttaccagtttcataaatcaagggatgtcactattcaaaattcagttgccatcaaggaatttgaattaaattaaaaatttccaacaggttcaaggtcaacaatgactaccatattaagaaagcatgtcagagagaacagaatcctgccattttcactagaattatctgtcaaattctaagaataaagtgttctctaacttgctggtgagaacgtgtcagactctgagacctctagaattacatagctaggagtgcaggacaggagatgcatatgtttgtccaagggcatatgcatatttgcaaaacaaggagaaaatcaaaacttattttaaaatctcaatagaaacaaaaagatgccacttttttacccatctgctttcaaaaacttttaaagattggtaatattcattgttggaaagaatgcaggaatctagctctctcatattggtcaggaggagtataattaacgaaagtatttttggaaatcaatttggcaatttccaccaaagcatgccttccttttgcccaagtaaacccttcttctagtaaaacagcctacaaaagtgcttgcacatgtgcacaaatatatatatataaataatatataaacatttccattacaactgtaaaagtaaaaatttgaaaattgcctaatcatccatcagaaggaaactgaagaaattaagtatattcataatataaaatcaggctcgctaaaaagattaaggcaaaggacatggaaaagccttcaggatatactgttactcaaaaaagcaggtagcagaaatataaataatacatatagtctgatcttatttatgttaaaataggaatgcctatttggatgtatatagacacacatgcatatgaacggaaactcctggaaactccacaccagtctataaaaacagtggtcatgactgaagaagggaatagttttgggaggaaatgggatcttcaatttatactgtatggtggtgtgtttgtgtgtgtgtgtgtgtgtgtgtgtgtgtgtgtgtgtgtgtaagtggggtataaatacacacatgaagatgcacaaatattaagtgtacaagtcaaaggtttttgttcaatcaaaatatagagcattgccatcaccctgcctcatggcccttccctcttcccagaagtgatcactactctaatctttatttatatggatttcttttgtttactcttgaactttatatacatggaatcatatcgtacataaccttttgtatctgtcatcttttgcttagcataaaggtttgagatttattattcatattgttgtttgtattacagttcattgcttattgctgagtactattccattatatgaatacactataatttgattagctatttccttgttaatggatatttgggctgtttcattttcttttactgtgaagaataaagttgcaatgaacattcttataccagtctttttgtggatatatgcattcatttctcttggacaaataagtagatgcatgtttaactgcaagtgtaaaatggcacaatcccatgaaagactatttctcagccatatgaatcttctagggagagcagtggctaaacctcggaagcagactgcctgggctcccatcagaagtctgccatttctagctgcgtggccgtgggcaagcttcttaacctttgtgcctaagcttcctcacatatacaaggaaaacaataactgtatctaactcatagggtgattgtgaggggttgatgagttagtactggtaaaatgtttagaacagaccgcagcatgttcactctttcactcttagcttacagtaagaagaatgtaatcatgtcttgtgcaatattgtgcacacatatttagtgtctttttacccatttcagaacagcaagtattccaaatacctcaaacaatggactttggaatgcattattgaatgctttatgtcacacatttagctcccacttacactctccttaataatgagatgagttacattcctagcaggttatcctaatggaagcattgcaggaagctcatgacagccataggtaagtaagctgggatcctgaaatgactgctcaagtagatgggccacacacacacgacagaagctgacaatgcacattgcatgcagaatttccaataatagaagcttttacttgtaaccactgagattatttcattttttttttgaagcttgtaaataccattcagtactccagcaaagctataaattttaggaagctttcataaatattctaaggatttttttttatagcaagcataaatgtgctaaatgtcatgagcatgatatcctttccaggaagagaaaggatctggcctgctgtggcaacttgaacctaactctcctcccagcaaagagccagaagccagagcaaggtctgaagacttagctccaggataagccagatctcatggacttttgcaccttgtggcagcctctccagaacagcccagctgtttggctactagttttgatcatggtcaactgcataagtccttgtccaagccatgcagcaggatgcccaagcccacatccccacattttccatcctggcttccctccttgctttattcttcctcctctccctaccgatggtccttgctcccctgaggtgagtaccatcgcgcattgtgtcttccacctcctctgtggtgcttggggctacacaagggcccagagacaaagccaccctcagttaaatctcacaacgccaacatacttaaaaaagacatcatttgtcatttaccaggccagcaggacacaccaagaacatgataacatagcataagatagctaaaagaaaggtgtcaaagggagtgtccagatttgaaaacttgagaagtagaacgtcctggagggaaagacaattttagcctccaccttgtagcatcaggccccactagcaaaaccctccttcaggaagatgttcctattccttgttcagcctgataaaatggttgaatcatatgtgaccaaggggaccaagaggcagtgcagtaagatgtccaagatcaaggactttgttgccaggtcagctgcattcttattgcagcggcatcccttaccaagtctgtaaccctagtcaagttatctcattaggggatggggacatgaaatgatttaataaacctaaggctcttaaaatagttcctggcacacagtgagtgctttataaataacagtgtcacaggatccttagggtgttcctccaccagctggaaacctctgtggccagccgcacccctgcttgggttttgcttgaggccacaagcaaagtgggttcgttcaacccacttgacccagcaggctgtgctcggctcacactaccacctcagatcccatgcctgccaagggcaagccaggcatggagtgatgaggggtgtgtgagcaagcatggggtctgactactacgcacagccaggtgttccagctgcagtggggaggaggggggggcagctccaggcgcctgctccgtgtgaggctgcagctggaccaggtgtaccacaagcaacttccactgcgggcaccaggaaatgcggtggtacctggaagcttggagacaccaggtaccacagagcctcagagagggtgtcacagccctggctccgggagaccctaggtctgggcttcccaaagagccgcagctgttctctccttctcaccgcccactatatggtgagttgggggtgtgtttcagtcctgtttctgttcagctctttctgtcccaccattcagtgggtcgtaagttcttgtcccacttccaggaagaatgaagtatatggacaactggagggtgagcaaggtagagaggagcttcactgagtgacagaacggctctcaggagacccgaaatgggtagctcttttctgcaggcaggtcatcccaatgagtgttcagctctcagcaggtagctcctggctactcgtggcaggtagctcctatccacaggcaggttgtcctgaagagtcgaggagatctgaagcaggtagctccttcccacagctggtagtcccaacatctgtgtgaatctggatgagtccagggttttcatgggctcagaagggagaaagtgcatgctgattgttccatgggtggccatgggcaggcccagaaaaggcatcataagttctcactctgggcttcagactccacccagaacaggcagcccagcccccaggcttcagtctgtccctggcttgaaggtggggcttcaccagggatctgtccctttctgcccagaaacctgtctgcctcccactgccatcaacatgccatccacagtgcccaggatattcatgtagaggggtgcctgcaggcccatgccaagccatcctcagcacccctggcctcccacctgtgctcgtcagcacccaaagtctagagagggccgaggcaacaggaagctggagtgtcagtgctgccctgagcatgcgcgcacctggccaggttgcagcagcgcccaggcttggccacaactttgctccacacaggagcaggcaccaggagtgggaagaggacagggagcaggaacaggcacttctgagcctgtgggcactgggggcttcccggcccctgagagcgcagggatgcatgggcccagagccacagctgggaagctgcagctgtgcccaggagcatggagcttctgctgtgccaactcagtaaggggcagggctccagcctgttcttggatcccgctggacccacagagcatgcaaccccagctgtgcctccccactgcagccagtatctttgcagcagccactccagacggtccactgcagccatcaagagcctgatccccctgccccaaccctcttctagagcacttatctactcccccacttcactcaccattgactttcctacccaagccaagaaaaccttgggagcaatcttagcaggtgacacagcagaaggtaacaattagcaaaagaagggtttattttccttgtagatatttcactctggcggaggttctgaagggctgattccttctaacattctcccgtattctgaccctgaaacctcccccaaatatggatgtaacaccaccttaaatgtaaacagaacccagtgcctgaaagccaatgctaagaaatgatagagcctattcaggaagaccccaaggatggagagcagagagatcctgggtgactgcagatgccctcctacccctcctgatggacttggtaagattggcatgagcccacaggaaactccaaggaaaaaggcaagccagctttctcatcctcctcagaactcaatgttgaacccacaggcatctaataataagatgctcttccttgcgagcagaccacacacagatgtcagggccacgtgattaactaacgagcctggctctgatttactatttaccaaacaaatttcttatcacttggcctcccatctaggtctggtgagccagagagcacagggtggtcatgtagggctgagaatagtggccctgggatggttatttttcacattgttaagcattaaatatgttgtcacagtacatcgctctcactgtagactagactatatgctccggattcctggtccacatggtcaaagctggtggcagatgcacttccaggagggttcaaagcagggttcctctgccatctgtgcccgcatgaaaatatcccctgcttcagtatgttgtggctccacatatccacctggtgcctcaaagccctgcccagagccaatagcgcaggagtgcaaacagggaaacattgctcctgcttccatgagagctgaagccaccatcacattttgcctggaccacaggtctcttcttgcctccctggtctccctgcttccactcttgcttctcttttcatccattctccatccaacagcaagattgggtgtttcaaagtaagtcagatcatgcacttgttggcatacaatcttccaacggcttccctttcccaaagaataaaattgcacaccagtgaactttgctggccagtctcatcccacaccatcctcaccgttagccccagaatcaggaattcagtctcctttcagttgcaataacacagcagctccttcccactggaaggtataggcacaggctattttccctgtctgggattcctctccacagccaccactcctcccacagctgacttttaccctttaagtctcagttgaagtaatgcctcctcagaaggcccttttttgggcatcaaatgcaaggatgcccctcctatcactgagaatctctgacagcaccccatgcacttgtttcacagcactcggccaatttgtaagcatatatttatttgcattttgaattccttatggactattccaccaccagacaagcaggagtccatccccaggatattcactggagtgaagtaatgagtcctacccatgtcctctctggcccaagctaccatcatgtccaagttggacgaggatgctggctccaattgtccacccaatccactctctgctgggcagcagaaagtatacaaatagattatatcttcctccctcgaaaaacatttcattggatctccactgcctgtaaaaccacccatgtgttggccgggcatggtggctcatgcctgtaatcctagcactttgggaggccgagggaggtggatcacctgaggtcaggagttcgagacaagcctggccaacatggcaaaaccccgtctctattcaaatacaaaaattagccaggtgtggtggcaggcacctataatcccagctactcaggaggctgagctactccgctggggcggaggttgcagtgagccaagatcgtgccacttcactccagcctgaatgaaagaacaaaactttgtctcaaaaaaatatacatatccatatgtcttcacactgacttctaccagatctaactcctactgtgcaagtcttatctcaccctactcccccaagctacactggccttccatttgcactctgacatgccaagccctatagtcctctgcggctctgaacaagcagtttcctcttctagaaactgtttacctcacccccaccctgccccttccttcatcactgataactcatatttattttttcaccccagtataagcatgatatcctctggaagctgtcttggcctatcaagaaatttaggtcctcctgttactaactcccaaatcacaccatgcctgtcttgccatgaactcaccacacttctgctccttttctgtcttccttgttctgctataggcaccctctgtacagtgatcacacctaccttcttgtcttctctacactaagggtctagcacaatgcctagtccattgccaccaacagatttctgctggtgacaatttaatttaatttatttctggaactgaccctcactttggtcaatggatgaaacaagtcccccttttttgccacatgctttatgtgaattcttaaaattatttaggaatgtgcatccagggatttacatgaattaagtttgctctcttacatctgttttcagaaaggcactttctattaaaaaaaattcaatttcataaaatgattgtcagttcctcaccaatgaaatgatacccagtcaaaaaaaaaaaaaaagccacaaaaaacctggactgattcttcacattgacttctaccagatctaactcctaccatccaagtcttatcttatcctccaccgccaagccacactggccttccatttgcaccctgacatgccaagtcctactgtcctcagggtggtaggtgatgatgaatactagtgagtactgttagctggtgctaacaatgacaacctagagttatcattcctagaaagctaattttcaaaattaaactggaaatctaagaggccgaggtcaaaaaagaaaaaaaagcctgggtaactctttctgaatttaatttgtattcaacagatgatttttaaaatctacatagttcacagcagactgatggcttgttctcatttatgctgctgagaaagtctttccaaagtctggaaaagtggtcagcaatctttttctgtaagtggccagatagtaaatatcttagacttcacaggccatatggcctctgtcaaaactacttaactttgcctctactttctcatgtagtacaaaagtagccacagacaatatatacactaatatatacactaacaatatatacattaatatatacactgtgttccaataaaactttatttgcaagaacaagtagcagggtcagatttggcctgtgggcctgaatttgctgaaccctggtctagaacatgagaccagggctatataatcaccacagcagcaaatgctcatattacttactctgtgacatcacatgatgtgctctaggcactttacatatattaacttacttaattcttgcaaaggccttactaggtaggtcctatttgtttactccttttacagatgagggaaccgtcgaaagttacagagctagtgaatatcagagccaagattctcaatcattctggctccagagactatctccaactcttaacctctatgctatgccaaccaactgtgcagaatgttgcagagttccttcccaccactgtcccactttcccttccccaaatcaaccctacaaagctctatggagcacaaatgggaaatctcaggatactatgtctgttctgtagttcagccacttcaagacacaccactccaaacttcacaggacgcccctggccagtagcttggttgactattagagaactagatacagatgaggtcattatttgggaacattagctttccaccagaagagcttcaggatggaaggtgagagctcagcagctttaatgccacagggcagcaacagttattgaaatgaggactcagctatgaagcagaacacaaaaccaacaagggaacactgcaatttccctgttaatttccattctctgaacccattaatctcaaggtgatcaccttttgaaaaaattataaggttctatggatggatatagccccaaaagcagaaatttgtattgtatttcacatcctggaacctaagtgtatcacaatgagtttgattcttcttcctgtacagacagattaaatctgagacaaagagtttggagataacaaagtaagtgaagataaaaacagaagctcaacacaacgttccctttttgtaagagaaggacaaaagggcaaggactatagagatactaggtaacgggtctgaggacagagcttcaggaccaaaggggcaaacccaagacagggacaagacataagataaaaactcctgccctcttcccacctcatatctcctctttgcacattatttacctcttttcaaattaaaaaaatggaatctgaacactttgaaaacaaaacattcatttaattgccacaattccatggagtactgtatcattctaaaagcctacgactccactgttagacacagccacattagggccaatttggtagggtgtcagctgtatttacagtttggagcaatataaaaacatatggcaactgtgaaaattgaccccctgggggctaacgctggaggaaaccaacattccgcagtctggccagaggttgagggcgatttgcccagacaatatacagccaaggcagcctataagcacaaggggcacttcgtgtatgcaagacctacttttattgcatcccatctgaaattgggctgcagtggtccagacataaaataaaacggaggtataagaagataaaaatcttatatgatgattttccaaattagagtatggaagtaatgtgttggcgtttatattatttgctatcagaaatcaattttaaaacattgttaagtaataaaagcatcttccatgttcaaatgttggattatgcatcagatgctgtgctaaacactgtaaaaatataatctcagttaaatgaaacaacatccttacatggagggcacttcatccccattttacagatgaagaagcagacgcttagagaggttatataatatgcccaacatcatatacttaaaaagttagggatgcagaatttgaactattgttctgatgatgccaaagatcatggcatctattatgctatataaaaataataaaatactatcgtacattactgaggccttggccacaaaagagaatggaacataataactaggcctagacattcccttttgaaagctacaatctttttttttttctatgaggtaggcaaagcaccagctgcaataaagcaagttatacactctttaggatctggtccatctgaggtgtggcttactggatcaacccaaaaataatttaaaccagcactgaattaggtttctattggtacataacaaattcctacaaacttagcagcctaaaaccacatttatttattatctcacagcttctgtgggtcagaagtccaggcacagctcagctggtccctctgttcatggtcttaccaggctgaaatcagggtgtcagccagactgcaattctcatctgcaggcttaaccggggaataatgtgcttccaagctcattcaggtcgttggcaggattcctttccttgcagttctatgcctgaggttcccagcttttaactggctattagctagagactggaggcttctctctggtctgaaaggccacccaaagttccttgccatgtggccttctacctaagcagttcataacatgcctgtttgattctttgaggctagcaggagaatctccactctgctgagatgaagtttcatataatataacataatcatggcagtggtactccatcacctttaccatatgatataccctatttaagggaatggcaaccatcacctttgccatattctatcagctagatgcaagtcacaagacctgcccacactcaagtggaggaaattatacaagggtgtgaaaaccagggggtggagatcatgggaccatgtcagaatcctgtctctcatatgcaatatccaatagaactttctgcaattatggaaatcttctacttctacgctatccagtagactagccatgagccacatgtgactattggacatttaaaatgcagcccatgcaactgtaaaagtgatttttaaatattatttaattttaactaatttaaatttaagtagtctcatgtggctaatggctgccctattggacagcacagatttgaacattaaccaatgtccatattatatgttagctattttttaaaacttcttaaacctttgttttatttttgtgtttgtgttcttctttctaaatatttcataatcattttactgcccatttcaaacagttcttagggactattcacattagtatctacctaacagacttcatttttccattgtccaaaacttcttccaaactattttcattaatgcaacttaaggcatctggaaggcttaacttatgctcaatggggggttacggtaatttatgcatccttacactttcccaagtatttatccccatgacaacacactacaaaaataaatggctgatctttccactcttcttctcgtaactcaaacctcttctcttagtctgatgtgaatgagtaaaacagaatcagtggtgggtggtggatgaagcaaaaatcaatgaaggataacaaagtggcagaattatcggcaaagagggcataaaccacttccccctgattaaatgagaagacagaacaaaccacttccccacacaattgcctcaacacaaccacttccaaaatccaccgctaaaatgtcacctgtttcagtttcacttgatgacatatttttcctaacccagtggtttccaaatagcgttctaccagtactagctctagggtatgttaataacgttaccaaaaaacaaaaacaaaaccaacaaacaaggggctagggtcaaataagtcttgagagcccatgtacagattcctgacccctggaacataagccttccctcttcttgaccaagcctatttcctcaatggacataatcctccatactagagtcatgacaggaactttacctagtgggattcatgaaaatcctgggtacccacagtttttcatgccctttctagtttccacctggatggcaatgtttctagagctcccaggggcagggtggccaaacatttaggaatgttaccctatctaaaacccacagagcagccactaggatctccaactcaggtgcctaagcatgtatgccatagaatgtagcatttgatcagcatctctttggaccaggcaatgttcatgttgtatatacacctcatttaatcctcacgacaatcttatgacatagatattacatagaccagaaaaatgaggaagagcaggaaagcaacgtgcttagaaggctcatctagctagagggaggcagtgctggagctccaccccaatctattagactccaaaattcatgtcactttcctaactgaatacctctgatttaccacacttcctaattccctgttatcagagctaaccatgataatcctaccaccaaaaagaaaaaattcactgggcagctgtaagactgtttatccaaagctacatgactcccacccaccatgggctgttccaagtgctttctctccttctcaccacagaaaactcagtaaatacccattttttcccatcagaggacaaacacacaatcacatgcatacatatatatttatatttatttcacacacacatatccctaaacagtgcttgtgaggcatctctcttttacatgtaggctctgccttctgtataacagagacattgcaaagactaaaaactatctgatactccttgaaaatagacagacaggagtaagcttactctaacattcttcatacagcatctaaggaaacgttatcagtgaatagctgagatttgagaaataactaaagttttcgaaaattcctatgggataatgtatggataactctttattaaatgtagctgtagcataatttagaaatgagaaataatttaaagtcatattgtatagatggatttttctatactagtaggtaataagtcaaattttttaagaaaaacaccaacactaattagatgaatatgaaaaatatttcattaagattcaagataaagcagaaaaaaggaactgatttgcaaaaattaggtgttttcctgatgatagggtctcaacctcgtatttctcagcccatgcagtgattctgattactattaggccctttttctggtataaatcctaaattatttcttgttgtaccttataaaatcagaattcttccttcaaagaagaaatttataagaaaaacttgcccctttctcagctgaagaaactgaaaacccttatgaaatcaacatcttcaaagcccaacccatgaagaaagcaacattttatctgctgtggtttaaatgtgtcccccaaagttcatgagtaggaaacttgatcgcctatgcagcaatgctggaaggtgggggcctaatgggaggtgtttgggtcatggaggcaccgtccttatgaatggattaatgctgttgtcctgggagtgggttccttatgaaaggacaagttcagccctctctcaccgtttctgttgtactctcttgccctctcttgcctttctgcctttctgcctttctgcctttcaccatgggctgaagcagcaagaaggccctcaccagatgccagcttcctgatcttggactttccatcctatagaaatgtgagaagtaaacttctgttcagtataaattacccagtctgtggtatatatagcaccacaaaacagatactattcaaaaataaagtgtcaaattcttaataacttgttgtttcatagtgaactcaaatctgctttccttatatttttaattacttgattttctattattttctttttttaacattatattttaatatggatcttctagaaaatcagagtattggcttacattccaaatgtagaagtgaaatgacaaggaacagtaatttccctggctgttgatgtttattttctatgttgctgtttgaaggaaactgattaaaagaaaactcctggcaacacctgaaaacatgatgactcagaaaaagaatcacagttttctcaccgaacaaattgttgggagtagaatatttctgatatagatttagaaatctctatgaactgaaggcatttcctgggcaattaatcaagagaaacttttacataaaaacacatctcgattgagctatttgcgtaagagcccacaagctgcaatgactaattataagtctcagacctgtgcagtttgctgaaatgcttttctccaggccgtcaaaaacaccatgacaacacacaaattcaacaagaataaactaacaatgggaagctacaattacagaaaggaattattcaaagtatgtgacctttgcacaaaaatgatacacgtttatttgatactactgactctcctctatttccgccctttgataggtctgtgtaattctcattaacaataatgagagatatgtgctaaaaatgaatagctgctaactccagccatctgtgcattcctggtacaaataaaattgaatgtcatcactaccctattggatttctcagtaatgctctttgctgataagaactttaaaaaaataccaatggctttttttctttttctaactcataaaaaacatgcccattccccttgctacataaaggggtctattctactcggaatccaggcagccactgagaggtgagggtgagataaatccttgcttatcaagataactgtttccccagtcagtataaatggagacaaagtatacccagactcgaatgattaaaatggccaaattcttagcaggttaactcattacttttcatccttctcttgccagccctgaaagctaagtagctgtcttaacagcctgcagcaatcacttccaaacaactctcctgccctacaggagaaaattaaaggtaaaatggacttaattcatttttcctttatgaattactggctgtcaaaaatttgagaaaggtcccaagctttaatggatacttttggaaagagagatcatgtgctatagaacccaagatggtatgctggagagccagaaaagctggaaaactggaaagtcgctggtcaggaattttatacacatacacacacacacacacacacacacacacacacacacacacacacccttcaccactgtatatacaggaagagagaagccagtatgaccatctccagtcccagccaaatgtctctgcagtgacaactgaagaacacatagcatcacagggccacatggttctaccttcacttccctaagcagccagttgacctgcagtaagccagcctttgcaagagcacctccatacacccctttcagggttgagtgttaagtcctgcttccgaaaacccaagggtctaatgatcaggtgaattgcttcttcctctagagccacacagaaggctgtagtgcttgggatcctctcttaggtttgatcattagatctagttttatatgacatacgatgacagaactgctaagaatatttattagcttggctaacaactaaagaaaaaaatggtaatcacagctctctggagaggctttttaaatttcattttatggcactataaaatgaggccataccctgagcatttaaatgggcaaattatttggttggaagtagctcaaattttgaagttcagtcacactggtagacataaaaactaagcaaatattcaaggtaagcatccatttcaaaggtaactaagacattaccaaaagagaggaagcatttatttcatataaatggccgcatgtgtgttgcaggagcatatatgtttggggtcaaggttcgctttattttaaagttttggcaaaatgtagtacctcattgaaccatcaaaaaagcagtgccaatataaagctgtcagctagtaatttatttgtaaacaacatgtttaattataatagcgcaaataacaaatcacaaatcaacttactttctctgagagcaaaatttttaaaactattccctttacaacttattaaaaaaatttagtattgtgtattaaacaggattttaaaaggacatatcaaatactaataattactaattagtaatattactaattactatagtagtattagtaataaaaattactaatatacaagaaaaactaacagtcatatatttaataagggtctagcatctagaatatataaataccacaactcaacaataaaaagacaaataacctaattaaacatgggcacagaatttgaatagacatttctccaaataagatatacaaatggccaataagaccatgaaaagatcttcaatctcactagtcattagaaaaatgtaaatcaaaaccacaatgagataccacttcatacccaataggatggctatggtcaaaaagaaaaataagaagaagtgttggtgagaatgcagagaatttagaacaattatttattgctagcgggaatgtaaaatggcacagccacttttgaatacaatttggcagttcctcaacaagctaaacatagttaccacgggacacagcaattccacttgcagatatacagccatgagaagtgaaaacatatattcaaacaacaacttgcacatgaatgtccatagcaatatttttcatatcagctaaaaactggaaacaacctaaaagtcaatcaactgatgaaaagataaacaaaatgtggtatacccacacaatggaatattatcaatagaaaggaatgagatggtgatacatactataacatggatgaaactcaaatacattatgctaagtaaaagaagtcagtcacacaaaaacacataatatataatcccaattaaataaaaggtctcaaatactcaaatacttagattagtcgttgccaggggctgggggaaagagggaataaatgagggagaggggagtgactgctaatgggtatggggtttctttctggggtgattaaattttaattctagaattagagggtggtgatggttgcacaaccttgtgaatataccaacaatcacttaattatacactttaaaagggtgaattttatggtatgcaaatatatcttaattaaaaaattacaaatgctagtaataaaaaattaaatgctataaaaaagtttataaaaagaaaacttatattgtccctccatcttccccaataaaccactctcactgttaagggttttctgtcaatctttctagaaattttttaggcataatgcaagcatagacacatctttaaaaatacagtggacaatactatacattttacagtatgtcttggacatctttccatgtcagtaacatatagattggggtatgaagaagggggctggagagagagaatggagctgaaagaaggaatgccagaaaggaactgaaatcaccctctgggtggtggaggagtaaggatcagtacctttctcaaattttcaaatgtctgttgaacaatcctggatatcctacatacatcttaatatattgaaattaaaatctcaactgttgcctcctcatagccaaaatcaccctccttcttctgtaccctttatcttcattaaaccacccaagattgggagtcaaagaggagtgagtcttccatattcccagaacatcacacacaatagatcactgtgctctaccattttaatttaaaatatctatcaaaatagttacctcctctcaattcttattgatactagctcagttcatgcctttgttttcattgtccagacactgaaatagctcccatttggcttccctgatgccaatctatgtacctatcattccatccatccttccatccatccatccacctagtcatccaacaaaatatttctgaaacatgagccatgggtcaggcattgagaacacaaaaacaaagaagttatcatctttatcattagaccattcaaagtttagtgaaagggagaaacatggagctgggaaatgataacaaaatgctttttatttgtgattttcttaaaattttactttaagttctgggatacatgtgcagaacgtgcaggtttgttgcacaggtatacatgtgccatggtggtttgctgcacctatcaacccatcatctagtttttaagccccacatgcattagatatttgtcctaatgctctcccttcccttgtccccaacaccccaacaggccacggtgtgtgatgttctcctccctgtgtccatggattctcactattcaactcccacctatgagtgagaacatgcagtgtttggttttctgttcctgtgttagtttgctgagaatgatggtttccagcttcatccaagcccctgcaaaggacatgaactcactgtttttatggctgcatagtattccatggtgtatatgtgtcacattttctttatcgagtataacattgatgggcatttgggttggttccaagtctttgctattgtaaatagtgctgcagtaaacatatgtgtgcatgtgtctttatagcagaccaggtggaactatcgtcttttgagagaaatcagggagtaacattaaatttgaacttcaaggatgtatagaggtttgcaggtatatagaaagaaagggccatttaggcaatgggaaacgtatgctccaatatagagagatgggaatggtctgtcaagtgcaaacaatgagaaaacattgggtgaaggcaaacactgaatggggaatgagggggtagagtgacattttatgtacttagggtttaagatgagacttgaaaacaactcaaggccagattgtgaagagcttataaagccaggaggtggagttggatattctgcccatcctgcgaggaggagggaacaggggcctccagacacagggtgttgcctcactgattttatctggagtagaggacagagactgggacagattgtgactctctggaggctactgcaattgtccaaattaccaagtgggacagcaacattgagagtggggaaacaaaaggaaagaaatggaatctgttggattagttacagtgagggatgagctacaggccacttagagttttctatcttagataaacaggtgaacgttgtgccacttccacacctaagtgccaaatatatagagtagtgggaggatgagtgaaagaagtggtgatgagtcctattttggttgcatgggaagtaacaggtagacatctttctaaaacacaatcctgttccccactgccttcagaataagttttttaaaattgtttttatgatgccatgcaagggaatatccatgtgtgcctgttcccacatgccccttgctcttgagattatctaggttcaaatccagagtgaccttgagcagattacaaataacctcactaacctcagtttagtcatatgcccattgcaaatcatactacccttccagggttgttgggattagaaaaattcttgcacaccagtgttttgcacagacactggcccattaaaactgcttaacaaatgagagtgcagttttccaagaaaggcacttagaattatttttcccccaaattacattaaaaatacagaggtaatatagggttttagaaaggtcttgtgtgtttttaaactttacaaaacttagttgatcgtatgataaaaacagcctaaaaatagcatttaaaatgtagggaagtttagttagtcactttacccaaacattttaattttagaaaactatataaaagtaagatgtctatcagagatgagaagagaaaccaaacaaactgaaaaacaaaacaaggaaagaaatcccactctctctagcagccgggagaactgagaagccagcacagatcctttctatcaggcataccgacaaagtaatctcagcttaaaagtttaaagtttaaaagtttaaggaaaaaaataaaaaacacctaagctctgtaggaggaagatgctacatcttgatggcatgatacctaccctctgacctgacataacgatgaggaaggaacgattccacagtgtgattactagccggacaggggctaatacgtggtttgagttctcagtccttgtcttcgttatgtgctgccagcactcccacttgtatcagacaagatcaaggcagatacagatactgtgctgcagagaagtccatctccccttcagagagttgttttccaaaaggaaaaccatcatatatcaaaacaaaggccttcatttcttttcggctttgatgctgctgcggttctctaatcacactgtgtggggccatgaagaactgtcccaaaaaatgattcctggaacaggcataaaacccctcctggaaatacatcttttctcttggctgcttccccagaattccccgcagggaaccatcttaagcaggcagaaggatggatgaccgaggtcttcccccatctctgccgtccacgatccttgaagcgcatccagagctgactgtctccagtctacgaagccactgcctccatgaaggcccactcaccaggcccactcaaactcacttcaaaaacaggaatttcacattccggctcaagagagggcaaagactcggaccagcagctcaaaaaagctgctagaactgccaacacaaacagcttctcaacttccattataagaggttttcatcaacgcctggaatcctttgtattatagaaatagctttccaccccaaaagaagcacattaaaaagtagtccctatggtcccaggagtgcttgagccaaaccaattcatactagcacaaaaagccttgctttggaatcagacacagtgtttatgattctggccctggaaccgaaatggctaagtttgaatcctggctccactacttaatagctgtataagagtggacaagttacttaacttccctgagccttggtttcccgatctcaaaaatgggactgagtaatagcacctactgtcttggagttgctataaaaaaaaaaaacatgaattaaaccttgcagaatgcataggaccagggctaacagcaaataggtactcgacaaagcctgttcttatttctgctgcaattataggaacataatttcctatagtttcttccatattccatatagtttccatattccatatagtttcttccaatttccatagtttcttccaccatgcctttattttcttcctgctctcttagtagctaggtttttttgtctgtttatttgtttcttctgtcttgctggctgttgtggaaacatggccttgttcttctggaaacaaggaggatagagatacaggctgaagatttttgtacttttgtcttttaaaaaaatttcattaattatccctacatcccctaaaactgtgtcttcttattcatcattattgcttctagcttgggctactgcctatctctccagcacagagatggttcaggattaatcctcccagaagatactcctcgttatgttcatcccaggctcaaaaagttcaaaatcttttatctcagtactcaaggctttcctctgtcctgatcagccctttctgcccttcttctccctaccgcagagtctaagctacagacagccccgtttcttctgagcatgccttctatcttcctacctctcttgccattgcttaggctccccatctagttctacatctggtaaaatcttttccatttttctagtccagcacaaataccaccacattcatagaaatttcccaactcctctctcctctgaatgtccatgacattcatatagaatttgtcaccctgcgccatgggtaatgcctctttgccaaatttcagattttcattccaatctgcctactgggcagggctacctagcgatcccaaagcatctaaaacacagcctggccaagatctctttgttcttaactctggtcatattttccatacttgttcctacatcctgccacagttagccagggatctcgattatacaggtgggtctcaccgaaaccaaggaaatctgagaaattggccttcccaagaggaaaaagaagaaaattatattccttctgggtctcacagagaagagtacggaaaacccatcctgggtccaaggtgactctggacccagggttgttttattgtctcatgaagcaagagttggctcacctttcaccccctgttgacttggttcccctccatcactgccttgatgactcacattccactccgaatgccttttttacagcttcaaattacgcataatttctacctccttataactccatttctttacaactcacattatttcttcattctgtaaatgtttattaagtgtctactatttttgcaggcactggttggataagacaggtcctttctagatcaaagttctactctagactgaaagacagatattgaacaagcaagtaagagtgtgccctattttctagtgggaaactacgtgaacttagacaaacctaacttgggcctgtctagctccagtgaagagcaaatgatgaaagtgacatttaaagttcacttggcctaggaaaaaaaataaatttatatccatgcttcatacctcacactaagataaattccatgtggttcaaagacttaaatgcagaaaatcagaacataaaaatactaagagactgtgtccccagaaaattcatccattgaaatcctaacctccaaagtgatcgtatgaggaggtggggccttttgggaggtgactagcaatgggatgagtgcctttataaaagaagtcaaagggagcctatttgccccttccaccttgttctcacacagagagaaggctctatccatgagtcagaaagcaggcgctcaccagacactgaatctgttggtacctttgatcttggactttccactctccagaactgtgagaaatacatttccactgttcagaagctccccagtttatattttgttatagcagcctgaacagactaagacacaaatcataaaattactaaaagaaaccacaggacaattgttcttatagtcttgtagtgtggaaggggcttctaagtatgatacaaaattcagaagacataaaagagatgactgaatacatttgactatgtaaaataattttgtaaagaaaacctgcataacaaaaaccaccattagccaaataaaagaaaagtgacaaatgtcagatcaaagacaaacgtatcattttcctaatatataaaaagctcttacaaatatataagaaaaagaccaataaaagaatatgacaaagtataaacacatttaaacatgtctattgtcacttgtaataaaataaaagcaaatcaaaactgcacttaagggtcattttccacctaccatattaacaaagataaagtttgaaaagcgcattgcactggcagagtttatggaaaaagaggcattcttacacattgttgatgggtctgtaaatggtttagcctctgtagaggacgagtggtaaaatctagaaaaattataagcatagtaccctagcaattccacatttaggaatttatcctacagatatattcacatacacttgaaatcaagtctattcaaagttattaattatagcagactgcatgagaggaaaagactagaaacaacctaaaagtccttcaaaaggagacagactcaattaaatagtatgcagaggtgaaaaagagtagaaagcctttaggtatagatatgggaagatctccaaaatagtttgccaagaaaaaaaagccaaggtgtagaacagtgtgaattacattataccacttgcacagatatcatattataaatactacggatctgcttctgtctctcacgatgctgcttctgggtgtagtgccagttacatcccagtgcctgatacagagcagacataccatcactatttgatgaaagcaaataagttaacgaataaaggagataaatgtttaaggaacacacttaaatacttggcccatcctctaaacgcaatatcagatctttttatacatgaatacagaaaggcagtagctgaatcctggatctctagttccaggaaaatttaaaataagtccttatataggacaaacaaggattgtatgaattagtttacatatttatatataaagattacttttcaataagcataagttcatttttctatgttcacttattcatatccctggggtcaagggaagcatgcagcaggattctgttttcaaccttttcctcaaaaatctctcaatggcttgggagaaaatgtctaaagtctttattctggcaactcaggtttttacaactagaaaagcaacggaggcagccggcttctctctcgtatcaactccctactctcacctgttactcttggcatgaaaatctttgtcacatccacaatcactgccacttactgagcatctcctatgtgccttgactgtgttccacgctcagtgtgcatctcaaccacatgcacatgagaggtaagctataatataattgtctccactttacagatacagagataggcttaaagaaaggaagtactgtgtcccaagtgctatagcaatgatgatgttgtttcttaggaggtagtctatttagttttctacactgaatgttctaacaatagataatgtcttgaataacttggactgtgaatgaaatattaatataaactaataataggtctgtgagagacaacacaagtgaaatcctagaacactgcttctttatctgcttaggaatccctaaaaagcccctgctttgcgtatttaggtggcagaagagcacccacactcagcaaggcgataggacacctatctgccaattacccagtgagtgtttctcaccaaggcccattcatcgcaggttatcagaagattcttcagttattcattattataaccaactcattctctccacggtaattatctgtgagcaacatatcatgctgcccttggaaccatcaaactgacatatgattaaatagcagagggctctgcagttaaatttaaaaccactctcttacacttcaactcacacatcacatcaagatctgttcagccacgagaatattccagttgaccaacaccaatggctggtgagagactatttcgttacttcatgctcccatgtgagacgggtggtggttatgttctcaaaacctgaaaaagggatttttcccaggacctaaagtaaaaatttgccaagcaattctatgtatgaaatcctgcattcatcccaggttaaaatgtctcaagacttgctaatattcaccattatgtcttcaaaattatgggtggaatctcactagaaatagtacattccatcaaaacactgtgagaatcacacactttacacctttcactgaaaaaagttacttaaaagcataaattattgtacatacagctccgtatatgccagtaagagaggtacttatattaacatggctaccaatctacaaaaatgctggatgagaacgtcaatctgcaagctggagttaaaacatgagtctcactgttcttggactggaaaaggagccacaccaggagtttgagatcagtctgagcaacatagtgagaccccacctctgcaaaaaaaaaaaaaaattcaattagctgtgcatggtggtaggcctgtagttctagctacttgagaggctgaggagggagcatcactgggcccagtagttcaagggtgcagcaagctgcaatcacaccactgtactccagtctgggaaacagagcgagaccctatctcttcttctttttttttcttttttttttttttttaaggaaccatagaggctcttcaagggaaaatttattcccatccccaaacacagtctacaatttctaaaactaaagttcttatgcaaaaataattctatagaacccactatgtttgcacgaagtgtaaattagaaaaaaaaaaaaaaaagctttttgtctatccccaataaaatagttgtacccaaagtaaaatcagctgatttctgggttctgttttatttttcacatctatttagcttaatattactctgaatctagagtaaaatgagagagcagcaaatattaaaatcatcaaaatcctccacaaaaaaaatgtcgaaagcatttgttatacgtaacaacaatgtattttcctcagacaaacatacacagtgcccactcatttttaaataggtccccccaaaatgtagacttcacaaagatgtgacactacacagtgtggaaattccaagcaccttcacccaatatggaagaaagtccagtcacaggatggttgggtttctctacaacctgagctagtattgtgcataatgaagtgatagaattcacatttcataagaaaagccatataaaggaaataagatattatttttctagaaagtgatttataataatactaagaaactatttttttaaattccttccccttctcagcatttacagaaaaagctaacacatcttgagagatttactatttgctgatattcatccatatggtagtaccaaccaaaagccaagaggatgagagaaacagggaaaagaaaaggttttagaaaaaaaaaaaagtacagatgaatgattaactcttaccgacttggtatctcttattctgggtcatgacttataaggcctacctggggccatccttcaattttgctgttgttgtttctccaaggaatctcagacacacactgaactataaaacgtttcaactacagtgccaattgtgttccttcagtcttcaccattctagagggtatagagtgccagaacagcaactcaagcaaaagctaaagagaaaaacaacatgcagcataaagccctagttctataaatcggagctggctcagcaaaacattagtcatggcaagtcccaccaaggctaggatcggaaaggtgtaagcaccaatccctggctacgcctcaagggttcaaaaccatttctaaatatagaacccactttatgtctgcaggagttataaatcagggaaaacaacttttttccatccccaataaaatatttgcacctaaagcaaaatcagccgatttctggctttctaccagttttgcttgggcataaaattttctgacacttcaccagaaatgtcagcattagaataaggcagctttaaagaaggatataattttctgacctgtggataaccccttcaaccccaacaggaaaaagggggaaaagcacacctgaaacctggtttttccaattattagtataactgatacaaattatttttcttagtggccaaattcttccttacaggaagtattggtctctgaatttggtgaggggagggatcatgtcagttttactgctatatccccaacacccagccagcacagactctcacttgcagaaggatttcaatgaatagtcaaggaagaagaggaaggaggagggggaggagagggagagagaggaaaagaaggaaatagggattgaaagtgagagaagttcagatgaagatcttttcccctctccttttatttctgtcttcatttttcttgaacttacaagcattcgacttgatagaaaaccaatgacatcttttctcagggcctcatgtctgaagccagacatgacatccagtgtagacaactcagcttccagaaagagccccagcaactctccatggggacaaagaaaagaaagagtggggtgagacaaacccaatggttgctcctttgttcaacagcattaaagagcatgactgccgcctcccatgtgtggcacaacacactgtacagagcccacacagtcagtgggctcagggaaggctttggtggaagaggcaactcctgccctggctttagaggggcaggatctgtacaggaagaaccagaggcattcaatctcagcataaaaggagaggctggctggagaggggagataaatctcagaatgaaaggagaggctggctgcacagctggcaggacagtttttccccaaagtgcttcatggaatatattcaatgaacaccatattcagaaaaccgaggattgaacagaactgcacaggtttccttactgcagaccttctcagtgcttttactatgcaactggagcagaagtggcaaaagatcccatctgtaaatcaaaatggattgatttagggggtaaaaaaaccaatgccttttcttactaactgtataaatttagcacaatgttcaactttgatgaacacgtttcctcttacctaatatggaaaaaaaataatagtcccaacctcagttgttatgagaagtgaacattaaaaagaacactaaaaaaaaaaagtaattaattcagtgctggcacttaattaacaccaaatgtattactgttgctgcttctgctcctgttgtttctattattattattgttatcaacctatgtcatgaatataaaaaagaaaaatgtcacaccgcatttcttaaatggtttggtcagtttttcgtcaggtattttttggaaatgctgggccagcacacagtgcctagcctattacacagtaggcactcactatatatttgtggagggaatggggcaaaatactgaccctagcaaagaacaaattgcaggacactaaagggatgctctggcaaaggtgtttttcattatttatttgggcaacagacctctgagttctgggaggagtgacttcaccttttgctagaagaatgagggattgaaaacacagtgttcagctttggggaaacatcacaaagagtttattttggtacaagtgtttgaagtgactctataataacgagctcacgcctgctgccaggcgccagccatcagcttgagcctgcttgcagggcagtgcacgcggtccatcaccaacagccccttcatcaaacaggtgatgcccatgtgcaggcaggatcccagaagacttgctccaaagatggctccctcttctccaagaggggacactgaggcccaaacaaggaatcagctgacctgggatccaaagtgggctgaagaccgagagggcctgggagaagtctatgtcttctggttttacttggttgattctctggcaggactttgaactgaatcccaaaggatactttttatttttttagtcaattgctgcatacatttttggagataacctcatctgtcataagtcacatgctaatctcacaaatagttactagaaatataaaagtttcacgtaaaccctcccccgagtacaatacagagatcctgacaaacctctccagcttcccacctgtttgtgtatgaagacattcttgacagacatggagtttactggagtggagacctgaacagatttggaatatgatgcttgcattttaccaaacccagtacttaatatctgtccacctgaatttaagcatgagagtctacatagagtttgaagaggaaatgaagtcatctgaaaaagtagttggagggagaacttcccatggagtccacagcacacagaaaagtctcaagagttactgcagtttccaaacttcagattaggaggtggggatgtgcagggcaaaccataaactatggtaagaaagactagatacaatttttctaaaatacatgatatgtgtatacacatacacacatatatatacatatatgcacacacatacatatgtatctcaactgtatgccatataaagaaagtacatagtcagagatcctgcattcagttcaattattacattttatcttattttaactggtaaacctggaagtcattgggaataaagcacagttaattctggaaacttgtcaaagttgaacaaagcttctaggactctaaagactttttgtttccaagagggcagagctgcccaattcttcctacactaaaaatataaccagagatgattattcacaatgattgcacattttcatcatgttcatttgaggcaacaggttaaatgatattggaatgatatgaaccttgatgtaactcctatagttcatccaactagatttggcatgtgcattttgccacatcctatcaacacaccctgccccttgtccagagaaccactggacatccatcaccccttccagccctgtcttctgagagtcagagttcatgttctttcaccatgaaataggaaaaaaaaaacaaaaaaactaccacacaataagttcctagagcataaaaaaccacagtagtgtataggtaaaaaactaaaggccctgacaggaagcttgaggtgtgggagcaaaagggatccctggatctcaagtgcttcaatattaagaggtacaggttagggcagcaaagggaaggcaaaaggagggggatacaggcaggcaaggagaaaagcttgaagcttcattaaatgagtgaatcaaaaacttggagaaaaggtttggatgcatgtttctaagccttccccatcccacccttccctaccgcccattatgatgtctgtgtttctgcacacagatgcaccagatttgttctgctccagaaagtaaattaagagtcattaaatttgagaataagagcagttctctgggggccatgcttttaatctctgatcagatctcttggaacttttgagaatgacgctttcctgcaccgcgatgaagttcaggcagttcttgggggatacgcagtgtggtatgtgagagtggcagagaagtattcaaggactatgagccaccaggattggaagccagcagtgggacaaaatcagtagatgagcaggtttgtgtataaagacatgccttgttttgaaataacttggtactgtagtcaatggattggcctggtggtttgggtgatggggcagaataaagggttgcagaccctgtgtacagagaagaaaataattatcgcttgcctctcaatagagcaactatactgactgccacattgatgtgatgctttctttttttgaagtttagatagcctcaaatcctagaatgagcatcctttagtaaactcattgattgaatgataaagaaatcactacatattactatgttttattggaaagagaagttgtccttgacttaaggaagaagaaattatgggcttgggcctcctacattggaggaatcaagcctgggatgcattttcagacaaaacgcccatttcatttcttaatattggggtacacacagtcaacaatgaatcaggtcttacacttggttccatatgctatgccctaggtaattaaagtatgccttatggataataaaattgaagttagaaagttaaaaccaaaacaatgtcaggaaataacatgtgtgtacaatatgttactaacacattgataattttcaaaagtgactttttaaacagtattatacatctttcagaacacagtgatttattaaatgaaaagtctgaacagtttgcactgttaaatttagcttttaagttgctgtgtcatgggcagatattttgttctcctaggttaaattcagcatcctgcattatgtttttatccatggctccacgttgtatcatcctgcagtcaattttctgaactgctcaggagaaatgcactggggagttatcatgaaaatttctctcatggattttataatccagaaatagaattaaataatccaacactgacttatttccatctttttccttgccttttcccacctatacatccttttcataaaataaaccttcccaaggcatggaatgaaatgagcggggggaaatgcagtggcccgaggaaaaccatttcagaaatgtgtttgttaaacaagtgcaagccataaattgagcttaggagggaaaggcagttagaagaaaaactgaaattactgacctgagagtcaagctgattggagcaagggtgaaagcagcaatttggaggataagcagaaaggaaaagggatagcaaaagagaataaaaggaaggaaatgcattagttttaaacatatagccaacagatgttatatcagcaggtttataactaaacgaagcaaacttttatcttatattacccccaaaagccctgggcacacactgtaagctgttgtattaaatatcataccaaagaaactggtagctgctctgatatgtataattacaaaaagcactgatgtgaaccagaggtgtgctcccacagtacaatgacagcatcagcccttctctggaggaatatttatagagaaagttcctatctgtgtgcatataaaattttattatttaataaactgaaatggaaactactaaggtattagacctgggtaagtgctcatgtcagaaagatttttatttgaaccagtaagttggatggttatatcctatgagatatttttccttcatccttgaaaaccaaaaggagctgagcaatttggctttcggttcaaagatttccattttagatgcttacagagcactgcacatagcaatgatcaaagaccccctgaggagggcttttggtggtgtgccacccacctatcagcttccgcagcaaggacagagtaactttccaagctgagagtgatttttttcagtcagaaatacgaagttccgacttcattactgaaaatatcaagttataatactttttaatttgtttgtataaaaatatctagcatgtccgtctcattggttaaaacaataatctctattgtcaagcaaaaaaaataaaaacaagcaaacaaacaaaaaaccatattcatcttccaggctactataggagcacatagtggacattcattttgttgatctgtaaaatgccctttgcaaaaacaaagtggataaacaaatacttttccagctttctgctcaatggggccccaccattccatactataaaaaagtagttttaggtatttcacatgggaaggaaaaacaaaacaaaataaaataaatcctcaggataaagcttaagctagaacatttcaaatgaaaacagtgttgattacaatgatacaactgaaagagaaaatttaagattaaccacacggggaaagtgttgatttgataatcccttgtatctgaaatccccctgcagagtgttttgtgatcataaatgcgcaactgatctaaaatgagagttatgtcaggacacgatcactgtggggactttggcaacactggcccaagctgccatttcaaatccttctggatcaaaggtaattaaatcaaggtctgtggccaagccttaggaaatcctaaactgaaatagcaagcacacatttcagatgtagttgcctctttcaagggctcccagttttcatcaaattctcaaaggtgtctgtgatgtccgtgaccttccccaaaaagttgctaggaatggcatatagccatctgccacttgttttcaagaaattctttcaaatacattaacaaatgtaagtgaaaattactcggcaagaaacatttatatcaaaacaaataaaactggcatcaagttttttccatgtaccatgaaacttctaaaagatattatcataatttaaaaataataataatgctcaagtttacattttgaatggagctctgaaaggcatcaaggaaattatgttagtacattattgagcaaatcagaagaaaaaataacattctcttcctcaaacttagataaggctcttttaggcatctaaaatgatttctcagtgtccaaatgtctggtgatattatttctccaaccagataattaagtggaaggctgttttccattctgatgttatgtcttacgagtggaacccccagggatccagcctcctctccgcattggggaggtatgtgattgagggctcaatttgggcattctccatcctctagacaaataccaacaaaatccctaacatatttaagataattacatgaaaggtcacccaaactgattccttcccatgggcgggatgtgagaaatatagtggcagcaggtcttacttgacagattctattaacctctctctttcccctaagtcaccaaaggattaattctgaaactctaaataaaactcagagaccttgatgggcactgacacagaagcactgcatatttcactgcctctaaggtttaattagacactaggttctgtaatatacgtgacatctgacattggagatggaataaagacttcagctgaatttggaccaactctcagagacttgctcaaggcccaccacccacctagtagcaaactcccctgagctgcctgcagtccaaggcagaagctccccactgggccgtgcaagagtttacaggcataactgcacgtgggaccacactagagcaacatgcactttaaaaagcaaaatctttaatggctgatgagaaacaccacgcacatggaatttaagaggtaaatgcattgtgtaaatgccagccatgtgctatctggaatgggaagattaacagaatagaaagtaaacacatactgccttctgagagaggagggggccagtgtcaaggttgtctgagttattcctaaccctgtaccttttgttgcatacaattgaagttctggaatattttagaacatttcctccttttaaaagaggtcctttcactctggtaggtcacattacaagccagagaccacaaatctatttcaagttcaatttttggttttcaaaattacaaatttaattgcaaacatttctccatggctccaaaatggagatacatgtcacattgctaagaactctttagttgtcaatattgtgaggtatgaattttgtagttttatccagcaaatgacaatattgcccaatttgaaaaaggttgcttgacaactggaagaagatgttttggtcagaatacacatgtagcacagcagataatgcttcagaaaggcaggccaaggctgagccctttttttcccaagaaacttcccctctgaatctccacccccacctccttaggggcctgggctggggctgaagctcagacatttcccagacaatgctctgctgctggacgcaagacacgggcaggcagagtactgggacagactcaggtcccaccacacgttttatgaattacagtgcctgggaggcatcagctttaaggggaggcaaaggcagagataaagaaaatgtgcagaaagtacataaagataaatgcctgtaaaatcactgctgctttaatgcattccatattgaagaaataaaaatctgaatattcttgatgatttaaaggcaatagtgtccagctaagacctgtttgtccaattagaccattaagctgtttatatgtaaatgtttatagtagcttgtcctgattttcaattacagttctggggggctggtttagcatagaaaaaatgccatctaagcgtgaagcacatcactttctctcctgtatgctaataaagaggtagatctcttgcagcccagcagcaatgcctgctcaggaaggctgtatgctggctgcttgactgtttagtgctgctgtactagcttctttcttctggcccattagcggaagggattgttctcaatggctcatctgtcagccctgagtttgaatcctgattagattcttatgagctctgcaacctggaggaagttacttaatctgtataaatcatagtttctcatctgtaaaatgagaataatgacagtttctgtattgtgggtgagactaaaaggtacacagtattgcacgtcaagtgcttcccagagtacctggcacacagtgagcatagaatatacatacaatatacataccctagtattacaaataaaactactataatttttaatattattatctagggcatcctccacatagctcaccacttctcagagcagtggactaggaatcaggaaacccatattacagtttcacatctttctgactacaggcccaatctcaggaaggtcatttaacttttcaagatctcagtttcctaatcaatgaaagagacatgatcataactttcctgtgatctcatgtcagtttttctaagaaaaattttggttctaaaatgtagttccaaaatagatccatctaaaatcacagtgctccccactttttaagaaccagcagactagcagaacatcctcacattttaaaattaaaacaaagccctttaaggattctatttgggatagttacctcaaaaaaaaatgaaatccttgactttactgctaaaattggtcacaatgaataaaaatcagattatcatcaaactaatgctattatgaagagaaatattaattgatttggaatttgaatgtaccaaatattataccggaaaatgttgaaattttattggaaattaacctacttgtttaatacagagacaaagttgagatttttttttcttttcttagagagaggaatcttgaccccaggctggagtgcagtggctcataatttactgcagccttgaactcctggactcaagtgatcctcctgtctcagccttctgagtagctgggaccacaggcacacattaccatacccggctaattattgtagatacaaggtctccctgtgttgaccaggctggcctcaaacccctaggctcaagccatcctctcaccttggcctcccaaagtgctgggattatagatacgagccaccatatctggccttgataatttatttgttttagcatttgttcataatgatatacatgttccactttacctggggaccaattgcttgcaaagcatcatttgaataggttgttagagattcactcacttctaacaagattcaaggccatgaaaggctaaggacagatgattgcttgagtccaggaattggagaccagcctgggtaacacagtgagacctgatctctacgaaagatttttaaaaattagccaggtgtagtggcgtgcacctgtagtcccagctactcagggggccgaggcagaaggatcacttgagcctagaacttcgaggctgcagtgagttgtgaccatgccactgcactccagcctgcacagctggcaaaaagcagaggcaaaatttgaactcaggtctttctgtcactgaagcccatgatctttccacaagatgatagagagctactctgtgtatgtcttgaagtcctttagggcctcacaagtgtctcgatcaaagctggctaacattcacaggtttattcaaaatttggtgatctcttccatatggattgaatctgggaaagacaaattctgccttactgctgaaccaataagaaatctgcagaggttatggagttatgtaggatttttcagaaagttttttccttacatgaagtacaggaaaagacattgatagcaagcttatttttagcatccacactatacataaatacaatacggatatgatttatctgaaaatctaaatactctgatgcaacactccctgtttttacacagaatttgctatcatgcaggacctattcaagtatatgtatttaaaaggtcctcttaagagataaacctccaggatgaatttgtcatgatgtgccaagagacatccaaaggatatgagctccttccttcttccgctatcttgaatgaagaattcccaactatattcttcggtttttggtgttggtggtggtgttgttgttgtttgatcaagacaaaactaaaccacaaatatttacctgtgatggaaaagaactgaggttttgggtagtcaaagccccaatttcttacacacttcgctggaaaaacgctagatcatggacatcactcaagaaagttgaccactattttcttcaacactgaagaagtatataatccctcagaagataagccaattgcattcttagtattccacagaaacgtcatctttcacaggccatattcctcatttatgacttgtttctaacttgtaatatgaatgtacagtccaaatccaccacaaccggagatgggcaaccacgcagtccatgttctctcactgccaacaatttatataactgtaaaatttacctctccagttctgcgatcttcttgtccttgtcattcttctcattctccacctccttgaggatctccagcaaccggtccacttccgcttgggccttgccacactcgtcgcggtagtaagacgcctctttatcgagctgttttatttggtctgcaaactcagggttcatcctggagtcatcttcaatattatgtgccttcaacattacatttttaaagaatgtagttaagacaacaatttagaacaatagacagtgctgtcaccaatggtccagaaattaactttggagagaaaatcaccaccaagatttatgggtatattgtcagtgaaaaggcaaaatagaaaaatcacacatttcagctaccttagaagaatgctgattttaaaataatattagagtttcacaggggagtttcttcaattattgatattttgttccattaaatgttgctacttttagcttttctttccaccaaaaagtagggttagatactgtgatgtctttattcccggtcatttgataagcagacctaagacaattcaactcctcacagttaaggaggtgattcatacaaaatgcttccatttccaatacaaagacaccaaaacaacacaatattggattattttccaagaactatcaagggcacatgtaaagccagataacatataagagactgattaactaataattgaacatgtcattccactgagaaatttcagcaggaaatatagtttgaaaggaggcttggaggtgaggaagggctttccagctaacagttatacccataaatcctcattctcttaaataaatttaacctaaaccaggaggaggatgagctaattcatgaacaagtacacagacaagaatctgcaaacacatgcatgggtgggtggcagcttcacacacaagaaaagacacaggcaacaacacagcaacaacattgcagaataatttgcagccaaagtatttgtgggtttgtgtgtgagagagtgcgttacagcttttttttttcccaaaataaacttttggctgaaatattcccagacagatagaaataacactgcactgcaatgttttgcctaccccttgtttcccattattcctaattgacttcttcaaagagcaggcagggaaaaaacaagtagtttatacaacagtgcacattcaacatagaaagttcagataagtcatatacgtatgtatctccaaaatccatgggtgatataatcaaatgttaacaatttttaaggacttaagtttttctgctgtcttgctacatggagcagatatttattgtgtttttatatacttttttgaaaatttcagggaaaaaacaaggcaagcaagctacagctactgtgggattgaatgaatcatgcatggttagaaaaattaatactaatactacggttagaaggtttgacagtctttgcaatgatttaatagaaaaaaaattcaaaaattagtataaataaaataaatttcatatgacaaaataatcattttagaaataatatttttgcatgtaacatattatttaagcatgaggataaaggggaaaaagttgctttcatgttcttaaacctaagatttccttatttaagaaataaactcaattacacaaaaaaaaaacaagaaaaatatgtcaattcaacacactatcaggtactggtttattcccttttaccaacatttttcagaaaacatttattttcatttatttactatgcactctgtgtttcattataatagattattaaactttttcagtacaattaaaataatctgaaagagaatcctgagctaacatacctttaggagtatatttatctaataatttcattttaagcttaagtaatgaataaatttcctaatctccactttaaaaatgtagagcagaaattctattttaaaagaaagtaactactccatatacctgcttctatttgtgacaatatgaatcattacttttgttacagaaaagcatttaaaatacacagcttttaaattgctaaagaaaaacttcgtgttaacctctctttcattttcatactgtattaccattcttttacagcagttaaaaaccttttcatgacatttcttgaactatccaaacaaggctattaagatttttaaaaaagaattaatgactgagtaatgagcagctggaagccctcaaaacaaatgaatacgtatattttgattgcctgtttcttaggacagttaaaactcctttcctgatgctaatttttaaaagttcacaaatagctagcagttagttgctgtggcttattttggttgtttttcttattattatagtccgtttttaataagtgggtacaggattactagttgcaagaccaagattctaaatccagtcctgcatcttatatttacaaaagattaggcaaattaattagcctaaaaaccatgaaaactacaaaatgacaaacacggggggagatattactcacttttgtttttattataattattatttcataatatgcatcccagaaatacagcttgttactcagctaagttaatagatttatttgattttcattgacaagatactacatactccctaaaaaaaaaaaaaaaaaaaaaaaaagcctccctgataggtttacagagacagcgtagtctgctagagataggtatgtacacatattccttattttagctccatgaagaaaagatgattattcaacgccacttttcaacagtgggtgaaatcagatgaattcatagtcttttcaaacaagtaagtaagtatggtgaaaggactcatgggatgtttagaagcacagaaagcctaggaaaaaaagtgcctgaatctagactgtaccactgttgacatcatttgatgctgaagttaggtcatgtcattagaatgaagaccagagccaagtttacgactggcctggtatctattattaacagaacacacttcaagtgctaatgagacttttaaaataaatagacaacctcggccgggtgcggtggctcacgcctgtaaacccagcactttgggaggccaaggtgggtggatcacaaggtcaagagatcgagaccatcctggccaatatggtaacaccccatctctactaaaaatacaaaaattaactgggcattgaggcacacgcctgtagtcccagctattcaggaggctgaggcaagagaattgcttgaacccaggaggcggaggtttcagtgagccaagatcatgccactatactccagcctggcgacagagcgatactccatctcaatcaatcaatcaatcaatcaatcaatcaaatgaatagacaacctcaagaatacctgtgagttaaatctctctatctctatatcaatatctactgattttcaggcaaaagaacttatgtcaagccactttcaatcttggtgccagaattgttgggagagctattaaaatgtcatttaaatgtttttaaatcaacagaaagctttaagaaaaagtcatataaagatgacagggaaaccgctgcttcttggatcattactagggtccatgtaaagactcaatgaaagagagtttcacatgactgggaaggctggtgagtccccagctaagcttaggtattggaggcaaaagcctctaaagaatttacaaaagatattgtacataaccagctctattcagcctgagtcacaacttttcagaggatgggctgaaatttttaactagtaaccagcatgaatgtgttctaccatgatctacagacatgagtgattctacactaaataaaatagtggaggaaattgagcttattaaagccaatgcttccttcaaaattatgagtcctgagcttcctccaaaaatggaatgaaataagcactttatttgtatttaggcaatattctcgccttttcaaataacaacatgagttctttaatctgactagcagctcccgatagagatcaaaagtaggtaacagacttggatctatcatactttagacactacagcgaaaaaagcagatttgaataaatcatgatcacagtaaattcctgccatggcattctaatgcattcaagacataaattgaaaatgcacagtaatatttttccttaagaatatgttggtttgcaattagctccccaacaaggtctgggaaggcttgccctttctatacttctaaggaacatcaactttgtcctcctattttcattagtcaggaatttacctcttaaaaacacaaattggtgtgagttttcttttgatggtttcagatcttatttaccatgaatatagcaagctcatcgtcactttcaaggacatccaccatcattaaaactaaaggaatatcaataagcattctttcattaatatagagatttaattccactgattaaacaggtcagtttaaaggcaaatccaggtatccgattctgctcaaaaatatttcttaaaacatttagagcaactctcaagcatcttatagaaacacaaaaaaatgggaaaaggacatttcagaaatgtctgcatcgcatactacatcagtaagttttgagggactcccaattatatttcttgtatttccatatgtaaggaaatgtccccgcaaatgggaataaccaaaacaaactctggagtctcactgatgtgggcaggcctctgggttttgatgtgaactgactttgaaagcctagatcaggcattaagaggactctgaccatggcttgggatgagcagtatattaacttatagttataataacctagtagttattttagtgaaagaatttataactacttcaggaaataaggcaaaacttcagattaatactatatgtaaatgaaagttaagaagccaaaaatggctaaagccaaactatggggttgtcaagtatcaaaatcatacgtctatttacatttaatcttctaaagactggtcattgattatttccaataaaatggcagttcatcaatccagatccctagaaaggaaagtattaactttggtccagaaacctgctgtgaaacaaggcagggaacattcaattattacattatataacacgttccctttgaaataaaccctaccaattttaattaaaaatcatttccctcaaaataaacaaataattaatcatgaccataaaataaaagcagaatgttaacgaatgtatttgatgacttttcttccctgctgtttctgggttttagcaataatttgctaaatttaggcagtgtagaaatatgatttcgattgtggcatgttggtggtttaatgtccattgacagcgctttaatattcctttcatatcttaacagcagaacagggtatagaaactattttgaaaattatatttgactacagtcttctaaaagaatttcaatcttctcataattctaagttataaataaaatattacattttaaaagaaaatttttaaggtgattattgagttataatatttatattatatattatatatgttatatataacatattataactctataatagactgatataactctattatagactgatgaaacatacatattattgtttagaatgaagaaccaagggaagaaaaagaacccaactgaagataacctgcatagtgtttctaataataagacaaaactccaggagtagaatgatagttaagctgcagaaaggttacaaaaaaaaattacaatatcaaggcaaaactttaggttcctaatttagaaaattaaatttcatttaaaatatatcaataccaggcatcattgctgagcctaaataatacatttggaaactaataatgatgtattttgaaatgttatacatcttaattctgtttttttttttttttttttttttttttgtgtgtgtgtgtgtgttttttgttttttttttttttttggtagagatggggtttgctatgttgcccagcctggtctccaactcctgagctcaagtgatcctccagccctgacctcccaaagtgctgggattacaggcacaagccgccacacccagcccctatatatcttagttctaaaggaaattattcactcacaattcaagctaactgcattcagaatattcaaaaatttgtgtattaaaacaaccacaccaaaaaaattattttcatagatggaacaaataggatatgtataaataaatataaataaatattcttatgtctctctctctttctctctctctcacacacacacacatacacacaaaagaacaactgtatgcttaatacttctaaagatcccccaaacaaaactgtaattattaatgcaatcctttttaattatgggatttcctaaaattagcaatgtagagaactgaggtaattatctggatgtcctcaaacaaaacatgtagcttcaaatgttgagtgttattgcaaatattagttgagttttttagacactgaaagcctggatcaattatagggtatgtgtttgtgtgtatgcatgtgtttacacatgctatgtgcatgcctggaattatctcttaaatagttgtaactttccactgtgctgggagataactggtttaagagtgagtcgaatacttttcagaaataggcttcaaaaatcataaaaagaaactgctatatccaaacaatgactgtgaaagcatttataattcagcccattacgttcctgggactatactgtcctgtaatgacctacaaagcaggacattaacaagattttttttctatctctctggaatgaaacatgcctgctttttggcttttgttatgttttttgtaaacacttacgtaaaatgtgagccctgctaaatatgtgttgagaagagataggatttcaaatggatacctactaggcactgggtaccccaagtgtggggaacatcagaggggtctcaaatgtgccctggccaacagcaaggttgcacccagtgcctccaaatcagtcatttgccttttagcaacaagggtattatatgaagcactaaattgagggacccagaaggtctaaagatttattaaaattttttgaaagactcccgataccatctctgcatacaatgaccacaagggctacagcaaacaaggtatttgagactgatgaaacacgcatattatttgtttagaattaagaaccaagggaagaaaaagaacccaactgaagataacctgcacagtgttataataataagacaaaactccaggagtagaatgatagttaagctgcagaaaggttataagaaaaataatgatatcaaggcaaaattttaggttcctaagaaatgtcattagatattactttgtgcaatagagtgactaaagtaaaaggagataaaaagtaaaaggttcctttcgaccctagaaataaaaatacttgcagaagcacttaaaagcttaatccttgtttactctgacatagtgtagactgtcagacagaattgactataaaattatcttatttaacaaaaaacaactatactataattcaccaaaaatttgttatgtggccatatagaaaataaacatacaaaaataaaagaaatttcctagctatgataactgattagaaaataaaataataagtatatcatttacaatagcaacctaaaaattaaatatatatagatatgcttaagactatctttaagaagaaatatcatgggaaaatattaaacttcactgtaaaaagccactggaataaatacaagttggatcaggtttatgaatggaaagaaataatattgggaacatataaatagttctaaaattattttatagattaaatatatttaaaattaaaatcaacaattttgtgttttaattgacaaagtgatcctaaaatttacttggaatgatagaaaattaaaggctaaagacttaagacaaaatgaaaagcagaaataattaaggtgtaatttgttttactagatatttaaaaatataataaagatacaataattaaaattttgacccaacaaattagagacatcaataaaactgaacagatgcttagaaactaagacactcacccaaatgagaacttcatattcaataaaatagtatcaagatcagtggataaagagagaattgtttgataaatcatgctggataattagttgataatttagaaaaatataattagaacctcacctctcaacatgaataaaaatgaactaaagatggataaagggcttaacttgataccaaaagcaaaattaaaacattttaaatataggtaagtgaaatcagagaatagtttccagaataaaggtagtgaggaaagcctaaagaaaagtacaggtcaagaacctaaaaattgttctctatatacataaaaaaatttaggctaaataaaactgccataaatctggcaaaaattctatataaaacacagaataactcatataaaccaatgaacaaaacagtaaactcaaaagcaagtgcttaactgatttaaactacttacgtaagaaaaaatacaaaaagctaataaatgtactggaaaacctcaacttcagtagttattaaagaaagaaaagttaaaaaggcaaaaaaaaattccacctaaacatgtgtcaaagttatgtaaaatgacaattctcaatgttggccagggtgcggcagaaaggccatttttaatcagtgctggaagaagcatgctttggtggaattcctaggaaacttaagatagtaggaactattgggatctttacaaatcactggcacaggaaggaggcaagcacggtggcacatgtttgtagtctcagcaactccagaggctgaggcaggaggatcccttgagcccaggagtttgagaccagtcttaggcaacagagcgagacttcgtcttaagtttaaaaaaaaaaaaaaagtgatgggggaagaaattaccaacattagaggaataagcaaatagagtagaatagtatacaatcattaaaatagtattttggaggaatagttcattatatgagaaaattctaataatgtaaaaaaaaatagaatagaaacccaaataaacactttgaagtagagtgttagataagaaaaagaaaaagtaacacaagagtgagagaaggaaaggaggaataaagggaaggagaaggcaagaggagagaggaaagaaagaagaaaagaaaaagagagaagaagaacagcaacaacaaaaagatgtctaggtggagaacaatccaaatgttccagcaattatttctgtgccgtgagatgtcctgttattttttaattttcctctataggcttccatatggttgcaaattctctactgtgaccatatattatttttacaactaagaaaaacatagtcatttttaaaagacaattaagggtagaaaatccatcatgctgcatccctatcagtccaaaaaacaattggacaccaagacagggggagttaaaataatgagagtttggctatattcccgggatgccaaaccaatgggttagtttaattaacttgaggagaaaagtcagtcaatgacttttgaattagtcactgaaaagactgaaaagttcacgctggcatattagagacgcaccactggggtgaagtgaagtaaaagttgatgatgccatgtcactgatatttctagaaatggtctaaaagctaactgagagttatttctttggtcctacctatcctgacagggagagtgaactcctagcatggtcctggtatatttttgctgctgcaggaacaaggctctccccatctgtcatgcacacacccaaaacatgacattctttggttttcttcctgttcctaactagtaagtatgaaacaattgcagtgggattatttcgcttattttttaaacaactttttttaaacactcattttttcccagggtgttttcgagcttgaagatattccagtcttatttgtctttcttcacatctccactgtcctgagcctgcttattagcacttctattcaaatgttaagggaaaagaaacttaagctgattattttttgcttctctgctaaaatctgcattttgaaaaagaggttaacaaagatgctccagcagggttttaggaattctgtttgcaaaaataaaatgtgttgtaaagaatggagggtggaggctgaatctaactaagtacacctgaacatcttgcagatcaagctgtatgtatcctgaagcagtggcttaacaaataaaaagttgtgggtgcaattgtttcctttatccatgctattcattttctccataaggggatttatacataggaggtgattagaatgcatgatagcacagatcacatctgccaaatgataaactctagccatctttatgaagtattttcccagtaagccacttaagttcactgaacaaaaaagcttttcttctttaataagtttaaaaaacaaactgcttcatatattaataaatgcacacaagtcactaggataaaaaaaattcgtggtggcacctggctcattttacaaatatttttactagttacctttttgtactctattaagctataatcagaattgttactatctgttattaggagactatattatggtttgtcctcagccaaatggcatgcctttaactgttacaaaatccacagtaatgtcaagtatttaccaatctcaaagagcgtaaccctgtttttaaatctaaacctgttttaacttctgtcacttgaataaaacagatattgaattgtttgctattttacaaatgttgttatccctttcggcctagatatgcttgtgtttgaaggatttaaggaagagttccataagcctagatcttcagctgacttttgtttttctatagtctttgggctgaggttaagaaggaggtaatatcagagttggcaatattttcttgagttattaatttttaaatttcacattcaaaagaaatggcagtggcctcagcacagatcatttcttttgacagaacggaaaggggaagaaactcaaatattttcaaaacctccccagtatggcacaccgtgactggtgatcaatggatcctcatgctttgatatgttacagcgggaactttcagaaatgacttactgggttgtacatctgattgaacaactgctcagcttgctacattgcaaagttggggaggcattgaggcacagacagggaaagaaggaaagatccagaaaaacagcattagctcaacaaaatccatgcattcgcacagacgagttggttgttaaaaaagaagaaatttcagtttctaaacattccacagtgaaagcgagatgctctagggaaatacaaatgttgactttggctcctaaaaaagaatagctggaataagaaatgtaaggtttgtgttactttccctttctcaagttaaataacccatgaaataaagaaagctgtccacttttgatgatacatgaagtgctggcctccagcaatgaatcagaagaagtacttttggccaagtctgcaatttattacctgaacttcaaagatggtaataataaaagattaattaaacgttatcattgaatttatagctcttcttttacattaacacaagcctgaattttctattcggtctatcttcagaaaaatacagatcagcaaacagcaggttagcaatagcaaaatatcagtcagactttattggattaacttaaatgggaaaagaagaaaaatttaaatcagcaggaccaaaatactgtattatccattgcctattaccaacttctactgttgtctccggattaatagaaaacataattttcaaagatatcctattatgttccaagtgctttagaatctataatgttttcttgtctattttgtgttgaagatttaaatttttgtgggtttaaatgtgctgaatattattttaaactgcactctcaacttatattttctaaatacctgcactatttatctggggctcaatgtcaaggtgtacagggtgaaatattgtagaaactgttactttgctttaagctaagacacactttttaagagcctctattactttttccttcaacttgaatgaagtaaatgacaatgttatcatggtttaaagaaactccctcctcaggtataatattaattgaaaaattactaaagagcataaatcatattttgaattgccattgcttctcaattgatttctaatcacatagggtaaatttactcccccattttgaacctcaaatactcttttgaaagacaaaatgatccatacgtcaattatcagcctcttctcaactcttgggtgtctacttaagatggatgaatgcgcttaattacaaagcacacttataatttgcaattatgcattatttggttagtatcattttatcagcctcactaatatcagtaaaaatttcctcacacatgaacatttataagtagtgggatggaatgtataagggagttccttttctgcctataaccatttgtcatcacaaagtattgaaggcatcttaaattaacacagtataataaagggttaaagtaatcatgtgtctgaatgttctccacaaacttttatgtaaaaactccctttaccaatgtcaagcattgtttacaagacaaaaataagtttaaatcaccgtttggatttcattgccactggcagacaaggtttctgttcaacgacacacatctacaatgttgtgtagattttataggaaaaatacctggacactcacaaaccttgagcaaaattccattgggaatttttggtgtatttatgacataataaaactattatgttttcagctttcatttagtaaacttttatatttaattcacaagtcacgtacccttttatttaaaaagaggcccagacacacttaagcttttatagctgcttatttttccatgagtaaatgatgtgtttatatgtatattcacatactgttggcttatattttcaaatatttcatgtagatctcaatttttttaaggtgatgggtatttgaggtttttacggaactatttattagcagaaattaaagactactgaaaaaatattttaaacttttgaatttagttaatgctagacagccaaaaataacaaaatagcatttgcaggttagacataaatatatttaaattataattaccctatttaaactcactgcactatgcatttaggagatagtataagcaaagattatgtatatacttagaaataagttatcttttcataaatgaaataggtcctttacagcaagacaaccatatttgttactttaattctagtgacgtggtagaatgttaaaatgctgtcaggaataatgctacaatgtttacaggatttggtctgtgaatttcagtgtgtggtgtctacctgcgagtcaaaggaaaccacacactctgagtgatctcaggggcaaaccacagctatgttgaaagaaactatactgaattgcataaatgttgatttattaaactagtcaagtcattacacgaaaagtataagcaacaatatgtgaatctcttccttttaattactagtggatttcaaattcccatagatgatttacactaaaaaggaaggtgtcaagcatgtacctatagaaataataaatggagcccccgatctccataacaatgactcatcagagtaggtggaggacatctttcatgcccaggtctatttgaggccgtctttcttctcgactcagcacactgtgactaaggtaaaataatgcagggaatggtcataaggagccaatgaatttctctctttcacaaagctagcttaaagcctgccttatgatcacaaaacttttattaaataaaaaatattcttcataagttcatcccttaatatgcatatcatagataatattttgaagagcacatttatataggtcaggaatgtatgtcatatacccaatacatcatagccaagtcaatctccatttaaacaccctcaaatgggcaatttaaattcttttatttattgttcaagatttctgcttaactaaatattgcttgaaataagtgagatgatgagtggattgggaaatatattttgcaatatagagattttcttgctgttttgttattaaaggatttgatcggtgtatttatctttttctgtattagcaagtagactttcttagtgtgaaatttctcatgacaatttcctaaacatctctgtaaagtgaataccatatagtaacatttcagttatatattgcatcatacaaaatagtatattaaattttaagatatctagagtaattccttcacagatatgtgattccttcacatccttgaccatccatgtcatatttttcataactttagccaataaatccccatcccggtgtgtgctatgaattatacatagtcaaattgtattatatgctttgattgattgtttagattcttatcatctcttttgaataagtttatgagttgtcaaagggaaacaaaatgcttaaactcataatgttatgagttttatgtgaacaatgagtgcagacataccaaacaacacagggaaaaagtcaaagtaacaatgcatgactggaaatgcactccacaaaaatgtctgggtcagagaaaacatgttaatgccgccatgtaaatatcctatttcttttccaaagccttctatctacaacaagctttcttagacagtaaggccattttgatcaaatataaatagtcattctacagagatgggacttgacaattttggtgaacttctagaaagttaacaatgtcagaaaagctttttgcaaagttctggtacaaaaaaatgacctacatctgaaagtagcaaaagtttattaatatctaatgtggcttccggattctgtgatttgttgaaaacatttctatttttctttgctgatagttgagatttgcccagagagtaatggctggtttttataatatttttaacttctgctactattttgatctatttttcaagtttttcttaaacaggaaatctgagataatttttcaggtttacagacagatttgatagacttcttagcaataaagttaagagtatttaattaattcttttatcagcagacagcaacagataaggggtttgtttctttttaaaaacgtctcttcctgttccattttataaattcatttttaaataagcatgattctttttcttagacttcacttaccttttttaactgtgcttccaatttgctacattcctctttcttttgttcaatggctatttctagagattttaatttggaatcccttttcagccccgcagaggctaatgaagatgcatgttctttgaggtcaattaaactagactgaaagagaaagaatgtgagtgagtaaaacactgaaatttctactagcaatgccttcaatttgaacacattgattctatacatagcaataaagtgtgcagtagacagaaagggtaaatataatcttactaaggtaacaatagtcagctctggtcaggaaattaaagttggccagcttacagaacgagtaggatctaattgccgtagaatcaaatgtgaccaaatggtgtggtcagtaaatgcatgtttcacgtctcaaagtcatgctaatgatgtaagtcccaaggtggtctttacatgtcatagcaaaacagacaccctgaaccttccgtttacatttattgctgtcagactatgcagacattgagacaaatacgaaagaaaatactgactttaatgcatccgctcccaagagcaagtcaaatataaaagaagcctcctactacatttttatcaaatcccatttctttaacagataaatgatcaatggttttacaaacatcttctggaaaattaacataaaattattttaaaatttagagtaaattttatgtttgcgtcctttgcaatctagatttgacagatatgatgaatctttccaactcagacatagggttacctaaattgttccagtcactaatcatgtccagaaaccaacaggctccacatatagtttgaattccaaaaactacagaaataaataacttgcatatatcactgaacataactttgcaacctaaaagagcaatgtttgtcatcaaatatgaaatagcaacatctaactatgtgactcagatgtacaggttttaccccaaaacagactccatgtatttccttcttgatcatttgcatcacctaggaagatactaaagacacaatggtctctctgtaaacaacgttggctaataatttacactgggttgcttcatggacactggaataaccttgatgataaaaatcaccatcatccagcaaggtgcttctaaagccctctggggaacaggtgagccattctcattcttcacatcaggaaactgaggctcacaagagctgagcatcttgtcaaagatcacttagctagtaaaggcagatacaggtctcaaacccaggtctacaattccaatttcaatgacttttgtcatatcattcccacagaaataacaaaggatattataatccagtcactttgtcatggtgaagacatatcttcactccaattaaattataagctccctgctgacggcaactgcatattgttttcctttataaattttaaattgccagatgcaatagccagttttagtcaacttggctaggctctagtcctcagttattaatctaggagttgctaatagaaggcattttgtagacatgactaaaatctaccatcagttgactttaagtaaaggagattattctcagtattctgcatgggcctgatcccatcaagtgaaaggcctatgagcagaattcaggtttccctgaggaagaacaaattccacctattgattgcaacatcagcttctgtctaagaccttccagtcggcttttgctgatggcctgttctgcgaattttgaaaatgcctagcctctgtaactgtgtaagccaattccttatgataaagttcttaatctgtagaaaatgtttaacgtggttctgtttttcttgcagaaccctgactgacacacccagcccagtgccaagcacatcatgcagaaacaacaagtgtttaccaaaatgtctatctgaaagtcatacaatgttggcattatttacaaaactattttcacttacagcttatgctccaccacttcatcaagatctcttttcattagaagtatatacattgattttaaggtgcaaaccgacaaataacacttgcaaccggtgaagaatgctataaacaaagtcaaagcttccatatcttctgtcgcatacaaacaacagtcatcacagatcctccaactcagaatcagcagtggaagctaggaagagaactccattctttatattcataacaaagaaataagctcctttctaaaaagcaagtaggtttaaattttaggaaatacggattttctttctgattttcctcgaaactcctcttactcatccattcttttccttcttcatctagattcctaatttattcaggactttagtttgtgtggaattatcagtaccacacgagtgaggaaatactgcggagctaggagatagataactgtgctgtggtaccgtccagcagggtgaaaggtctataacagctctaaagaagatggacagttacagcagacaaaagtaagtgtgaaggggccaattgcaggcaatctccacgcatctcagagctgtgaggattaaataaaataatgtgtaattactgctgctcatacttctccaccgaactatccccaagaaaactgagagggttacagggatcccttgaagaatgggggaatagcccaaagcatcctcttcataacccccaagcaagaatttcttcaaagtataagattttactttaaaaacacaggtggcatttatattctgtattcatgtttgctatggtataaaaatacagctctaaattatttactataatgtaaaaataatatgccagaagagcagccacacttaagctctaccttggggtccagcatggtaccacatctcctaatctgagagtattgggtggtccctttgaaaagtacagatgaatgcaaagcacttgacacaaggaatagtacatagcagacacccaataaagtagagctattgttactatcatcatcgctgctgttgttatctcaagcaagggatcatgggcctgtgaaaaatacagaatcctttaagctgtgcaaatgtggtaagacataaagaaaagtttcaaggagctacattgtatatggttagcagagcagagaagataggcatagggcatcacagatgaaggaagttacaaaaaaaaaaattcctttaaattcaggcagctttacaaaagaaaggttactacattccccaagccttcatacagtgcctcctactaagtctctagtctcttgcagcttcattgaatatgggtttatgaggactatcaatgtggttcatttgtttttccagactcacctctttctcagtcagttcagcctgtaaagcattgaccttctctttcaggtctttgttctcttttcggaaggattctatctcttctagtctttcccgatcatctctttctcgctgttctttcaagcgctcaattattctctcctgtaaggcaattaacaaaaaagaagaggtgagaacccatcagtgtatatgccaaagcatactgtaaaagaaaataagaggcagtacatctaagaaatgctgtacaggaatcaacacacacaagaaaatcaaaattggattcgtggggaggctgtgcataacagcacttgggaaggacaaccaataacagcttttgacttgttaataaaagttaatatcacagggttgcaaaggaacgtaatgttcaagttctgtggttgctcttggttcatggtagtatccagcaaatttctagagcagctctagaagagggagcttcagacaccaagactccagacctaccacagccttgcacaggaaaggggaagaagtagaacatgcctcttggctccgccctctttgcttagcctctccatttgtcatcaaagagccttcattggtttctgaagactgttctctggctagatgggaatgaagtggggcaggacccaaaccctccaggacttagagctgggactcattgtgagaacttgagacaaagaatcagtccattgtgtatgtgattttccagtgtgtctgaggatgtttacttctgtgttttttcagtggtttcttgatagtcagcagagaatccaaaacactggctgagtttgaacgaagttcagcagcagctttattttattgagggcttactacatgctaggcactgtgatgtgctctcctcatcagccctcatcacaagcgcaagggcagatccagtgctcttggtgacggtgtagaggtgaggaaacccagagctccgagatgcaaggtggcccaggtcataaacagaacgcctcccacatcccaggctctctgactgtcagccacacccatgagaccacactgccacaaacatacacctggagccattcaaggaggtctgcctttgactttcacactgaaatgaaaacactgctttgtagacttgttttccaaaaatagggaatctgcctgatatcaaagtaagaaacttaaacacacacacacacacacacacacacacacatgcacacgaaaattccatctgcgtaaagcttgagttagatttctgaaattagtttgaaattatccaacacatatctaaacttcctctcggatggccatgttaaaaaatactggtgcaacaactgtggccaaggatcctgatactatcttttatattcttataattgcatagtgcaagacaatgcctgataaataagacaactgtaaaatagtatttaatgcagagggaagttagtttgaacagttagcctgtgatttaagatcccccgaggaagcaactgttctaccccactgacaataatttatatatctaatgctttcagcggaggaggtaccattactattttccaattatttaaaaacactttaaatgaaatatattattataagagaggaggcagaaatataacaaatgaaactattaattgcctatatttgtttcttcttgatcccagacctagtttacctacctgtgacaatggtgagtggatgactatgtgatccacaagagaaggaaatggccacagtacatggtcaatctctcaagggtttttaatgatttcagcaaccaagaccttgctgccttttgcccacactacaaccaattacccagccacctctccgtcccatcccttccactacatggctgttggagcgacatttctaaagctccaaaaggacctgtcgtctcactatttggaaaccttcccaggaatccctctggctggatcacgtggcacttattcccactcggcagccttcacgtggtttcactgcatgatcatcctcccagccccactttcaagagggcagcactaaaatcctatgagtcttcttgacccacagctgggcaaatcatctggcatacaacaagcaattaaaagagctgaaggaaggaaggagaactcaattagggatcatcttggcttcaaagaaaaggtaataaaattaagcagacatgttaacagccagaaggtgtcagaatcgtttggaaagtaggtcgatttgctctaagcactcgtactattgactgggcattgatgacaaaaaaaatcaacaagcactataatgtttttaagtgttattgatgattcaatactacaacatatttctccgtcaatcacaaaaccaatttaactgtcagccgcgcagggccagatgtcaaaaacatgtgttaaaaggccctaatataccatgatgtacttgattaaaaactaacttgcagaaattccaacaatgtgttcttgttttagtcttatttgcattggcaagcattccttgtgcactcatctggctctgcacaggtctaatctatttgtgctttatcacagggtgggaactaaattacagtggcctccagctccactatctggctttctcaactgcttatctgctatgtggctacagcaaggctttgcgagaccagctttataaatacagtgggttccatctcttgagcttctgtgtgtcaatcctagaaccaagtcatattcaatcttaactcacggagaggcattattctttgcactctgttaatagttgaataagttcctggaaagtaaaaggaataacatactccctaggatgccataatccaggggaaatggtgaatactgcctgatggattcttttcatcagccaagagacagcaaataattaaatgtacttaaaaattcatgagtttttattaatcattttgtttcacagcatgccttgttacagggggatttgtgcaattaaatgtggataaaaatgggacttgtgagcaaaactccatttaaagaagattgtgatgttgccaaaagcacaaagatctttgagttttagtcttattctatcacctgtgagctactggccttgggatagtccagaggaggcagcaaagtctcaacgaaggaccagcttagacagggtggaaacagcttccaggagcggtgggttgagaagttagcatgtgccatgattaattaatgatgtctctctaggcccagaaatgggggatgatgctgtacatgtcgatatttttatttctgggcaaatcatttcacctcattgagcccatttcccatcttaaaatggaagagcatagatttagtgtttctcaaagtgtagccttctgaccacttggatcagaacccttcggtatatttaaaaatcagaggttcctgggctccacagcagagcagctgaatcagaatctctaggaaataggacccaggaaactgtattttaagaaacctcctagatgataagattatttggatatatacaaaggtttgatgcatactggaatacttagaataaatcttctattatttgtcctaagatagagaaccttgccagttcctatccaacggttttatctgtgctttccaaatacattaggcattctgattttggcacctttaaaaaattccctccacatccattgctctatatctgcttttattcttcatcgctatgaaaagttaaaaaaaaacagatgcaaacagagtttggaaataaatagctcacaaagctggtacatagagctcttttgtttgacttgagcatcataatttttaaaaatctgaacttgaatgttttgaaatagaccagggatctgcagcttaccatagctaccagtagtccctactacacttcagcaaagccacatccctcatttttgttccctccctggcccttctagtcgtctaagttctcaactcctcatctgttgtccaattcagatgccatgagcctgagattgcagatcagcaaactgaataattcattgtcaagggagttccaggacagcatgaaacttagaggtcagctaataaaaatgtgtattttgaagatgaggtactgagacgctgagagaagaggcttgcccaggtgatgcaactgtcaagcagtaaagacagtccaaggggccagactcccacagacctcagattccttcccagacaccccctcagcctcaaaggaagtacttaaataaagggagtagtttcagatttgggaattactttgggatttaagctagaataaatcaaatcttaatagggtccagaaaaaaaaataaaatcctgccaagaattcatgacatgaaaaattatatggtatatgtttacttctgtgaattttaagaaagaaatcaagaggtagaaatagggtgatatcatacaacccaaatatgctaaatgaacacataagcagtaatagtttttgaacaaacatcccctcattccaatgttacaaataaaactactgcagagagctctggaaataaattattaaaagatgaaaagagaatatctctccccaaaaagtcatcttattaaatattcttataagctttcaagtaaaaccttatcattcttataatttaatcctgaagttataatctttcaatgtttaaattgttacaggatttataactttattaaccagcaactgtttctcctccatggtttttttagcaaaattaatttggaaatacatactaaatatgatgtcaaataaggtaactcaatgtcaaaatgtacattctttatcttacaaaagcctcattttaattgtttgctatattttattttatttacattctgggatacatgtgcacgatgtgtaggtttgttacataggtaaacgtgtgtaatggtggtttgctgcacctatcaacccatcacctaggtattaagctcagcatgcattagctatttttcctaatgctctccctcccccgaccccttccaacaggccccagtgtgtgttgttcccttccctgtgtccatgtgttcacattgctcagctcccacttataagtgagaataggcagtgtttcgttttctgttcctgcattagtttgctgaggttaatggcttccagttccatccatgtccctgcaaataacatgatctcattccttttcatggctgcatagtattccatggtatatatgtaccacattttctttattcagtctatcattgatggacatttgggttggttccatgtctttgctattgtggatagtactgcaatgaacatatgcatgcacctttataatagaatgatttatattcctttgggtatatacccagtaatgggattgctgggtcaaatggtatttgttgttctaggtctttgaggaattgccacactgtcttccacaatggttgaactaatttagattcccaccaacaatgtaaaagcattcctttttctgcccagcctcaccagcatctgttgtttcttgacattttaatacctgccattctgactggcatgagatggtatctcactgtggttttgatttgcatttctctaatgatcagtgatgttgagctctttttcatgtgtgttggctgcataaatgtcttcttttgagaagtgtctgttcatgtcttttgaccacttgttagtggggttgtttgtttgtttcttgtaaacttgtttaagttccttgcatattctggatattagacctttgtcagatggatagattgcaaaaattttctcccattctgtaggttgtctgtttgctctgatgatagtttcttttgctgtgcaaaagctctttagtctaattagatcctatctgtcaatttttgcttttgttgcaattgctttagacattttcatcatgaaatctttgcctgtgcctgtgtcctgaagggtattgcctagattttcttctagagtttttacagttctgggttttacgtttaaatctcacaatttttaataggaccatgaagactagccctagagtcatgggtctttttgtagcttcctttttttttctttttttttttttaataactttttaatttaactccaaaaatatgcttacccatctttttagagctcctaggtttttatcatagagccttggttctcagactagagtttacatcacgatgacttggggaacttgctaaagtgcagattcccaggccctatgaggttctgatttggtaggtatagatggggcctaacaatagagactttcaacaggagcttcctggtaattctgaagtaacagaagagaagcctcctttaggatacactggcctaggaaacccatgggcatttaatctaattcccccattcatcaaatgggaaatttgaggccctgagagaggcaattacttgccaggctcacccagttaattaatggctccccagttaattagtggcttaggtgggactggcccctaggtctccttccaattacttcattaccccagagtttataggctactgtaacagggaatataggagataatgctattactctagtagggcatcccagaggaaaaccctcacaacatcccatgcatgtgtggacaaatcctgcaaagtgctgcaggatcaaaaatgatgggaaagatgaagaaaaagaacataataaaatctactcccacacttcaaaagttaacatttcttttcttggtttcaagctaaatttgaaaataatgccaataacatgggcctaaaaactgcgccagcacttccatgtccaaccaacaaacaagccgtccctcctgagaattcctagagaactttacctgcactggctctttgacattcaggaagtgttggaggagaggagagagcatatgcaaactcaactccagggtctgatacctacaataggtgcccagagaatgaatgaactcatttagccagaatgaaatggactggaaatcattttaaaagtaagtaaacatcagaatgagctgtttgcctaaaggattttattcattcattcattcttttattcaaattaatccccttaaatgtaagtcagaaggaaaccctcaggatggcatcccatccccttcaaagtaaaagccaatttttaaaaatcttgtctcacaagggcctgtgaaatctgctgcccttcctctcacccacacccttgtacttgctctcccctctgccagggctttctccctccacaagggctcctggctcaccactcactttcttcaagtgtttccttaagtgtcaccttctcagcaagctcctacctggccattctactccagcactccctgtacccctccctgccttctcttcttttgtagaaaatattaccctctgaaatcctaggaatgtcacgtatttattgtctgtctccccatcacctccactagagtctaaactccattagagccaggattttcacccattttcttctctgctgcatcccaaggctcaaaagaggacctgtcacatggtgggggctcactccaccagtatccagtactgagtgagcatccccaatgcaggttatgctgggcacagggaatggaaagataacacacacatagcatatgtttcttgggtttggagtctagcagagaagagaaattaaaaacagataaatgaacaattaagaatgtgacatgagctctggggagtttgtggtgttcctgagacataacggggatacctaggaggtgtccccaaggaaatgataaaataataataatagtgataacattacatctactattctaaacacattccatattttcatgcattttctcctcaatataatccactgaggtggctactattattaccctcttttacaaatgaagaaactgagaggttaagtaatttgtccaaagtagaaagtatcagacctaggatttgatcccaggcagtctagctccaaagtccacattcttgactactgcacaatacaacttctcatgaagctgacctctcagaagaggaggaattaaattagcagagagtgaggaatatcctcagctggggaatagcatctgaggcaggaaggagtatggtacagttgaaaatctagaagccccacataactagggaacagagaacctggaaaaagagaaatgggggatgaggctggaaatgaaagaaagaatgagggagggagcaggcacacagagtgggggcttgccagatcagatgggagaagggaccctgggggccaggtagaggatttcaaattatatcatcgtaagagcaatggcaagctagtgaaggtttttaaggaaagccaagagtgatgtaatcagatttgcatttcagaaaatgcccctgactgtagtatgccaagtccactgaagagggcttgtgtgggaagaacaaggaccagctgggactaaaggtagtgttagcaaaagaagaaaagcaggcacatttaaatgcattgggatcaactttccccaactctgtttccccatatcctgattccccagtttttgagtgcatgctcaccttctctgacagagcttcctctagcgtcgccagtgcagtatctgtattactggaatccgtctgcaaggacttcactctgtctttcaggttggtcagttgcttgtctttatccctaagttgttcttgcaagttttcaatctaaaaataaaaatcaatattttaatgcatatttgattacatatcctaggccaaaattcctgaagtggatctattaataaaaaaagaaagaaaaagacctgaaatgatagaaattgtcagtagctttgacttagacaaaaggccattttgatgaaatcttcatttctccatttagttcaagtctgtctttaaatggtgatacagaggagcagagtatctccctccatacaacggtaagcccttctgacacgtacgtaatcactattatttctttgtatttctatcccttttaccagccttttaggtctcaagtcgataggcttgaacttggtacactgaaccagggaaatattatgcaagattaattcattgattaaacagacatttactggagagcccattctgcaccaagtaccatatcagtatatggcagatcccatgtagccattcacttactcctttatttcagtattaaagtttgtgatatgccaaatgttgtcaagtggctgtttcaaagtaaccacatgaaaagccaagtaggttatcaccagcagactgttaatgggaagaacttgtgatataagtcaaatgtaacaagtactaaacactccatttggcaactaagtcatgtgctggcaaccaaccagccacttttatccactatctgcagcctgaaataaacacgccaaatagccgattacaatgcctgtccaggagcagcagcaaggactttctcctgggcattgaggacattatcattcatgtttttattctctgctttcaaaccatgtatttcttatctaaggatttaaaaaagccccactatacaaacaatttattcgtattaagggttttaaaatgacaaggaaaaaaagcagtacaactctaagataagtccattcaaaatatttgcattctgcacccagctttctcagggaatcattccaaaagtatgtttcacaatgtacactcaaacaaattttttgattacttgattcccttagcatgtatctggaatggtaatccaaataataataatagtaatcccagtagtaatgaggaggaggagatgattacaatgacaatggaggtggcagcagtagcagcgtcaaaaacagctctggatgcaaagacaatggctctgctgaccttcaatctggaggacatggtcttggctaattttttcaatggccacaatggaaacccgtaaactttgtggcctaacaaagatgaaattttttttctttccttcctttcttccagcctccttccatccttcgttccacctttccttcattcatttttttttcttctgccttgagatagacagcttagaaactcaggttataggtcaaataattattcttttccttcatcaaaatgtaatgtgttcccatccagctgccactgtgaaaattaattgccactccttggaaaacacagcaattcagaaggcataatcatctccagtcaaaacaaaggcttcctcccttccagacaaatgttcacacaaaaatacacataagtaagaatatggatggttatatgtcagaatgatactggttatatggaagaagccagcagctgagaggactgactcttggaaacagtgtatgttattactttgaatacacccatggatacatttgtgtacacacatgtacgcaaatccaccgtggttctgaatacactgattagacccactggcccaccctggcagacagtgccctgggcataagaggaggacatcagccttggggcagtagtaggcagcaatttcaaaggactttgggcacgagaaatagagaccaaaggaaaagtggctgtgcacttatgtcataatccctggggcctcctcatataactggaaagactagggagactgagggtcagggtcctactggcatgcaggtaggggtcaagagctgaagaaatagggatggtggagactggagacatgcgatctgtttatctcacatctaagaacccagcagaagagccaatgatactgcaggtgtgactgactaacagagctggaattaaagatgtatttattgagctagggatgcaccactttaagaaatgctgcaaaaagatcaccaagaatgactcttaagagaaaaaaataaggtacagaacagtgtgtagcatataatctcttgcataaaatttgaaacatctataaacagataaatatatctggaaacaaatcacaagaaattttaacttttgtagggtaaggtctaggaggcagaaggaagaaggagtttctggttttcatctttgtacatttgtgtagatttctgcttgaattttctaaccatgtgggttttattattttaaaatgtcaatcagggttatccagctggtaaaattatgggccatttttggtttatatttatacataaaaataataaatactatacacatgagtaaataataatttaataaataaaacaaatgcctacttaatactaaattgtccaagttgccagcagttacagattgttggcatatttatttatttttttaatgggagctaaattttttaattttaggtttgggggtacatgtgaaggtttgttacataaataaacacgtgtcaagggggtttgttgtacataacattacattgcccaggcattaagcccagtacccagtagtcatcttttctgctcctctccctcctcccaccttccccactcaagtggaccccagcgtctgttgttccttctttgtgttcataagttcttatcatttagctcccacttatgagtaagaacatgtggtatttggttttccgtttctgcgttagtttgataaggataatagcctccagctccatccatgttcccgcacaagacattatctcattcttttttatggctacataatattccatggtgtatatgtaccacattttctttatccagtctgtcattaatgggcatttaggttgattccatggttttgctattgtgaacagtgctgcaacgaacattcacatacatgtgtctttatggtagaatgctttatattccactgggtatatacccagtaatgggatattggcatatttaaaccatggcctattatgcaagtatttaaaatcctgtttgcatagcattgctaactaaatgaaaatagtagatctttaaaaagcagaatgtaaaatagtatggcattaattttgtaaaaagaaaaaattattgcatagaacaaaaatataaggaatctactaaaatgttttatttggcaatgggacgactgatgattttacttctcctcttcatgcttttctgcatctgccagtgtgttttcattgagtgtaaacagaataaaaagatattttaaaaccaactacaaaatatcagaatggttatttaagtgacttttgaacaataagtttttgctttttaaaaggactctgcaggagaaaataatcctttcatactccaaagatgactgaattcttaaaatttaaacttaaaagactggagagaatataaaattctgtatcttttaaaaaaaagtactgcacagttttctcatgttcacaaattgttatgacatttatatgaaaaatgttgggaacctttttcttcaaagggtgaggttgtgcaaggctcaaatagcaggaattggaaaataagcaaattgaaaacaagggttaggatgggaagccttgggggtggaaagggaagggtttttttgagaaatttcatattgcagaattggacaccaccttagcaacacagacaacaaagtatgagataggcctgagtacaagggagctagagagaaaccctgcccttgcctttgacttgagctgccttctggtcatggctgggaagattcagaaggagccagtactgctgaagcaatagctatgccttctggggcagaaacctggaaagggggtaagagaggaggagagctcagaccctggaggtcacttgacaaccctaatcctaatggctttagctgacttctgaagctctgcccaagaattaatggggtccttaactctgggcttgcaaagcctgagatgggccaatgttcagcaggggagctttgttgtgaatttcacacaagtgtagtcctcagcacaaaagggaccattgactaacagccacagcctccttgactccacatttgctcctccttccatttggtctccatgctgcagtcaaaggtaaccttcccaaaatgcaactctaactgcatgacttccttccttagaacccttcaatggctcccattgccccccacataaagcccaaactccctgatatcatacatgaggccctccgagggatggtccgtgtgatcttctacaatccctcagccaagccctggccctgccgaatcactagtgctattccctagcacgaggatctccttatatcttccctatctttgcctatctatttccttttcttggagccctctttgcactccaactgttcacctattcaagctctactcaaacctttagatatcagcacactccttgcctccttcaggactccttctccaaccccctaaaccaggttaagtcccctaatctgcatttttcatacactattaaaattgcttccttacttatctatttccacaacttggccatgagcacaatgaagacaagagctctgttctactcactgttgtatctccagctgcagcacccaattgttggcaacaccccacatattagcttactgaatgaatgaaaaaaggaatgaaggaaggaaggaaggaaggaaggaaggaaggaaggaattctaaagaaagtggcttgtgtaaaaggaagaggccagagtaggtgacggctgagtcccttcagctccgagattctacaaagaagtaaagaagtaataaaaagtgatggagaaagtctatacatagcttaaaacagaggacctaaaacatacttaggcatcgttacagtttcaaatatacccaaatgtatctttctggtagttttcattataaaattccaaaattcattcactaataaaatttatcttctctctaagatttgtctctggattttgtattacccacacctagagtatcagttaatgttattagctaaagcaacagaaacagctcagtctgatttaagcagaaaaatggggaaactcacaaaactgccagaaaggctagaaaatcagggtcagggaaaatagtatagaattatgcccagagttttgatgcaagtggtctagtgcaaacactgttgccccaactgctgaaaactagacatcgaggcttacagtacagtgagctctgtcccactcgttctctttggccgcagcacccaactgtgttggcaatactacatattaacttactgaataaacgaaagaagtgagaaaggaaggaaccctaacaagagtggcttcaactgacccccggacaacaccactagccctgcagtcatgttgccccatgatcttgactttgcagtccctgcagcagagagagggtccttcaaaatcccaacattccaatgacactggggcaggtacatctaatgaggaaagccaaggtaaggcatacagcccaactgcaagggaggcttagaaaccaagtgttagcagtttcatcttccatagtgagatgttcttcataaaatcagaacaaagcttggagtctggatggccaaaaattatgacccatatccacagcacctagggagagctccagtgttagctcttgagccagcaaactccaccatcctaaaacaattgctctggactttctttctctcaagttcctacaggctgacaaggttaaggtttgactcagacacttctccaaatatggtcccggcaactctttgttaccagtctttgacaagataactacagaaatcataagtgtgtatacagcatcctaatatgcaagaacatgatccatggacctgtcatcatgagcaatgtatggacaagttcaggtgttgttgaacctgtgtcgcacgtggctggaactgcacactgatcaagtgcacagtaagaccacatattgttccatgacagattgaaaattatttaaaaaagaaaaagcttgcttggggagcatgaatgcacaggtctgccaatctctccgtgtccctcagaggtaccttttgcagaatgccaaggatgctccttgagtggaaaaggcaaggctggttgctagtacagggcctaccaaaccatggatttaaacacaaagatttaagtcaacccattgtattaattttctacagttgcataacaaattgccacaaatttagcagcttaacagcatcagatcagaagtctgggcatggcctgattggtttttctgctgagggtctcacaaagctaatataaagggatcagtttggctaagttcccatcttgaatctggggtcctctttcaagctcattcaggttgttggtattattcagctccttgctggctgctggccaaggttgctgtcagcttccagaggctatatacaaaggcccttgccacacagtacttccctccctctttaaaaccagcaaccaagcatttctcacatagaaaatcaccctcctgcttggaatatctctgacttccctgtctctgacctctagccccagatttactgcgctcatgtgattaggtagggccaacacagataatctcccttttgatcaacttaaggtcaatagactagtgaccttaattacatctgaaaattcccttttgcataaaatgtaacctaagcatagacataacaccaacaggcacataatatgggaaccattctagaattctgcttattatacccatattttttctttgaaataaaaacatgttggtcctttagatctcttatacagagaattctgtgagtggaattcattcaaaatggaggaattctccactctaacaggatgtgtaacattttaatatggccaaaaaatggaataaaaatttgaaaacaaattttcagcttataaaaaagtaagtattgtatgcagcaaacccccttcctccgtttctttctttttttttttttttttttttttttcgagatggagtctcactctgttgcccaggctggagtgcaatggcatgatctcggcctcccgggttcaagccattctcctgcctcagcctcccaagtagctgggactacaggtgtgcactaccacgcccagctaatttttgtatttttagtagagatggggtttcaccatgttggccaggctggtctcaaactcctgactccaagtgatctgcctgcctcggcctcccaaagtgctgggattagaggcatgggctgccgcaaccagccaccttcctccatttcttgaaccgatctccattcttaagcaacataggttcccagcattagggtctattcaggaaagctgctttaatgagatgactatttagaaggcaacatatagctgtctccagtcaaaaagcagcctcacaactttcagctaatataacagtgtcatgatgaggaggaggaggaggatgagaatgatgaagatgatggccattatctattaagtgattcctacaagccaggcactgtactaaaagctttctttttgacattttattttgagataattgaaatttacatacagttataagaaataatacaaagagagtcctttattctttacctagtttctgctaatggtaacatctagaataattatagtaaaatactataaccagggaattgacattgatacaacccaacggccttattcatatatcatgagtttttatatgcactcatgtgcatttgtgtatttgtgtgcatctgtatttagttctatgcaattgtaccacatgtgtagatttacgtgaccaccaccaaagtcaagatacagaacaagtcccacaccacaaaaatctcttgcaatgcccttttatagctgcacacaaatccctcctgcctctgtcccatccttaacccatggcaaccattaatctcttctacatttctataatttggtcatttcacaaatgttatataaataaagtcacacagtatgtaacctgtgggattggcttttttcactctgcataattctctgaagatccatcaaagttgttatagttatcaacaacttcttcctttttattgctaagtaggtattccatggcatggatatccaggcttgcttaagcatttacctgctgaaggacatttcagttgtttttagtttgggctgttacaaataaacgactatgaacattcaactacgggttttattttttcggtgacgtaagttttcacttttctgggacaaatgctaccagagtgcaactgctgggttgaatggaagttgtaatttctattatataagatactactgcactgtttcccagagtggctttaccattttaattctcatcaacagtgtgtgaatgatctggcctctgtacatccccacaaacttttggtgttatcagtattttttattttggtaattcttataggtgtgtagtgatatatcaatgtagttttattttgcatttccctaatggctaatgatttttaacatcttttcatgtgcttatttactgtctgtaagtctccttcggtaaaatgtctcttcaagtcttttgcccattttctaagttttttgttttactattcaccgttgtgactcctttatattttctaggtattagtcctttgtcagatacatggtttgcaattatttcctccaagtctatggcttgtcttttcattttcttaacaggtctttcacagaacaaaaggtccaatttatcagtctttcctttcatggatcatacttttgatgtcactttcagggtttgttgcctagtcctaaatcatgaagattttctcctatagtttttctaacaaatttatactttcatgttttacatttaagtacatgatctactttttgttattttttgcataaggtgtgaagtttaggtcaatgttcattgtgttgcctgtagatatctaattatctaattgatccagcatcatttgtttaaaaggctatccttcctccactggaatgcttttgcacttttgtaaaaaatcacttaggcttatttgtgtggctgtatttctgggtcctagtctgtcccattaatctatatctctatccttcaataatatcacactgtcttgattacagtaactatatagtaaggcttaatattagtagagtgaatcttttaaccttattcttttttccccaagattgttttagttattcggggggttatgccttttcataagaaatttataaaaagtttgtctatgtcatcaaaaccctttggtgggattgtgataggaatctcattaaatctatatagcactatttgagcagaattgacacctttactatgttgagtcttccaattcattaatacaatacttatctaagtttgtttaggtcttctttagttgtgctcattaacattttataagtttcagcatacagatcctgcaggttttcctaagtttacatctacatattttattttctttggataactgtaaaccgtcttatatttttaattttatcaatagcttccacatattctgttgttagtatatagatatgtagttaaattttgtatgttgatcatgcatcctgagaccttactgaagtcacttactagttctgggagtgaggtgggttgttttgtttcattttttgtccctttttaaagattccttgggattttctatgtggacaacaatgtcatcttcaaaaaaggatgacacttttttctttccttattgcagtggctagggctttggagtactatgctgtataccaatagtgagaataggcatctttgtttttatcctgaatttacagggaatatactcagtcttaatggtgaaaaacagatgttcgctataggttttttgtaaatgtgctttatcaagctgagatagctctcctctgctcctaacttactaagagtttttattatgaatgggtattgaattgtgtaaagtgctttctctgtgttaattaacacatttttttcatctgtatcctgtttatactgtggattataataattagttttggtgtgctaaatcagccttgcacaccgggaataaatttcacttggtcatgccatattattctttttaaacattttttaatttgatttatgtaatattttgttggagagttttatatctaaattcatgagagacagtcatctatagggttgttctgcgggtttttggctttattctttttgttttttaatttgatactgtctttttcaggtttgggaatcaaagagttactgccatcataaattagtaggaaagtgttccctctcatctcctatctgggagaaattgagtaaaattaggattaattctttaacattttggtaaaattctccagtgaagccatcagggcttggaaatttctttttcaggagccttttaactacaccttcaatgtatttcatggttttaagactattcagtcatctatttcatgttggttacttttggatactttgtggttttttagaaattggtccatttctactaaactgtcatatttatgagcataaagttgtctacagtattcttctattaggttgctaatagctacaggaactgtaatgatagcttctgtttcatttctgacattggcaatatacatcttctttatttttctcagggtttctggagatttatcaattttatttatgttttcaaagaaggagcttttaatgttattgattttctctgttgtttctatattttcgattttattaaattttgctccatttttattatttccttccctctacttagtttcggtttattttgttcttctgggttattgaggtaggaacttggagtattcattcaagatctttcttcttttttcatataagcatccaatgcttacattttcttctcagcactgctctagctgcatcccacacattttgatattttgtgtttttcttttcattcagtttcatgtatgtttttcctttgaaacttcatctttcgactatgggttacttagcagtgtgatatataattttcaagtgtttatagatccccttgtctgtctgttatcaatttccagttttattacattaagatcatagaacataccttatataaatccagtttgttcaaatttggtgaggtgtgttctgcaatgcaggatatagtttatcttggtgaatattatatatgtacttgcaaataatgcatttcagcagctgttgggaatattctataaatagcaatcagttgatagaattgatcagttctttccatatttttctaattttctacatttagtttcctatatttaatttctttatttagttcaattgctgatagtggtatgttgaagtcccaaactataattgtgaattcgtttattttacctttcaactctaatagtttttctttcatgtattttgaagctctgttgcatatacatttaggattgctatatcttcttggtgaattactctgttttattatgatataatgttactgatggtccatagtaattttttctgctctgaagtctactttatctgatattaatatagccattcttgcattttaaaaattaatgttagaacaaagagtgatgtcagtaagatggcagaataggagtttccagtgctaatcctctgacagaaacatcaatttgaacaactgtctatgcatgaataatcttcatggatgcgaattaatctaggagtaagtaattataccctccgaatggagcacaaatataagaaaagactcagtgaagagagtaagaacagtttcacagtatccagtcagcccttcctgaatcccaggcagtgcagcatggggagagagatacatggggaaaagagagtgaaatgagcacctgactttgccaaagatcctagcatcaggcctactccgatgaaccctggctccaggctggcccctgagcagtcagattccaggcccactcaatcaccaggctagcccctgtgggcagagctttaacactttccagtgaggatcagcactaggctggcctccaaatactcaagaccaggcacatagccatagacccaggcaccaggcctgccccagcccaggtcagccctaatgaccacagcctccagcctgtcccccatggatacaagcttttggtctgcacccagacaacaggctcatccctgtggaccccaacccaagctgatccccatggacataagatccagtcccaccctaaataacccagattccaggtctctaccatggactcagtactggaccttcccatgtacatgctggctccaggcccacccccacatacccatggctggccccatgcaaccaggtaccaggccagccagcccaaggactctagcagcaaacctgcccagactccatctcatggcccctccaaaatctctggacaggctaacaggtgaaggcctttccctgctgaagccagtctgtaaagactagaaaaggagtctacttcttcaaatgtgcagacaaaaattcaaggccacaaagatcaagaataatcagggaaacttgataccacccaatgaacaaaattaagcatgagtaaccaactgtaaagaaatgactatctgtaaactgactggcaaacaattcataacaatcatctttaaaaacctcagtaagctacaagaaaacacagacaactaaagaaaataaggaaaataacacacaaacaataaagaaatacacaaaaacaagaaaaaacaataaaacattctgcagctaaagaacacaactaaacttgaaaaattccactgggatttttggtatagtctgatttgtgtgacccctccaaatctcatgttgaaatttgatcctcaatcttggaggtggagcctaatgggaggtgtttcagtcatgggagtggattcctcttgaatggcttggtgacatccttgcagtaatgagtgagttctcactctgttaattccaatgagaactggttgtttaagagtctgccacctccctcttctctctcatctccttttttgccatgtgatctctctacacaccagctcctatttgctttccacaaaaagtggaagcagcctgaagccctcaccatgctgacaccagcatcatgcttcttgtacagcctacaaaaccataagccaaataaatgttctttcctttataaattcctgagcctcaggtattccttgatagcaacacaaatgaactaggacaaacttcaacaggagatttaatcaggcaaaagaaagaatccacaaactcaaagacagatccttggaaagtaccaactcaaaagaagaaaaattttaataagtctatgggacttatgggccgccattaagcaaagcaatatatgcattatgtgagtcatagaagaagtagagaaagagaaaggggcagaagattgtttaaagaaataatgacagaaaactacctaaatctggagagggaaatgagtattcagatccgtgaagccaaaagaatcccaaataaatataaaaagatcttcactgagatatgatcaaattctcaaaagtcaaaaacaaagataattttaaaagcatcaagagaaaagtgattcatcacataaaaaggaatttccttaagactatcagattttacaacaggaaccttggaaccccaaccaggcactgtggtgtggcacattcctgtactaccagctagctacttgtgaagtgaggctgtaggatcacttgagcccaggaattcaactccaacctgagaaacatagtgagaccctgtctgttggaagaacaaaagaaagaaaggaaagaaagaaagaaagaaagaaagaaagagagagagagagacagaaagaaagaaagaaagaaagaaagaaagaaagaaagaaagaaagaaagaaagaaacagaaagaaagaaagaaagagaaagaaagaaagaaagaaagaaagaaagaaagaaagaaagaaaaaagaaacagaaagaaagaaagaaagaaagaaagaaagaaagaaagaaagaaagaaagaaagaaaagtaaagtaaagtaaaaacaaaggctgggcagagtggctcatgcctgtaatcccagcactttgggaggccaagacaagagcattatgtcagcccaagggttcaagaccagcctggacaacagagtgagaccccatctctacaaaaaaggaaaaaagaaaaattagctgggtgtggtggtgcatgcctgtggtcccaattaacaaactattgtagctatagttatttttaatattttgtagagtaaaaagtcatttatgttccactattacagttttagagtaccaaaaatgtgatcaaagtcttacctttacagtgagttttaaacttttttatattttcatgttttggttagcatcctttcatttcaacttgaagaattcccagtagcatttcttgtaaggcatgtatagtggtgacgagcttctttcatttcaacttaaagaactaccactagcatttcttgtaaggcatgtctggtggtgatgaacttccatggattttgtttgtctaggaaacttttatcactccttaatttctgaaggacagctttgccaagtatagtattcttggttggcaggtttttttcttctttcagaaatttgaatcatgtaatcatccccacaagatttctctcatgtaagagaatttctctcattacaagatttgaatcatgtaatcatccctctcagcctacaagatttctttttttttcttttttcttttcaaaggcagggtcttgctctgccacccaggttggaaggcagtggcatgatcatggctcactgtagccttgacctccaaggctcaagtgtccttcccacctcagcctccacctacagactagcagcagtaagtccttacctataaataatcaggataatcaggataatttaatccatttactttaaatgtaaataaattacggaatcaaaagacatagaatgtctaaattgatttttaaaaacaagattcaactatatgcgactatagaagactcactttagcttaaaggacacatataggctgaaagtcaatgaagagaaaaagatattctatgcaaattgtaagcaaaaaagaataggggtgactatacttatatcagacaaaagacactttaagtcaaaaactgtcataagagacaaagaaggtcattgcataataataaaagggtcatttcatcaagaaggtaaaacaactataaatatatatatatatgcacccaacatcagaacatttaaatatattaaggaaatataaccaaaactgaaggtagaaacagacagcaatacaataatagtaggggacttcagtactcattttaaataatgactaggtcatctagacagaaaaacaatcaagaaacagtagatctgaataacaatatagaccaagtgggcctaacagacatatacaaaacattccattcaaaagaagtagaatacacacactttacaagtgcatatgaaacattctctaggacagattatatcttgggccaccaaacagtcttgaaaatttaagaagattgaaatcatatcaagtatcttttccaaccacaatagtatgaaattagaaatcaataatggaggaaaactggaaaattcacaaatatgtggaaattactcctgaacaaccaattgatcaagaaagaaatcaaaagggaaatttaaaaatatattgaaacaaataaaaatggaaacatagcatacaaaaatgtaggggacatggcaaaagcagttttaaaagggaagtttataataagaaacacctatattaaggaaaaagaaagatatcaaataaacaacttaacctcatacctcaagtaactaaaaaaataagaacgaacaaacccaaaagttagcagaaggaaggaaataatagaaagcaaagcagagacaaataaaattaagtttagaaaaacaaccgaaagaacaaaaaaactaagagtttgctttttgaaaagataaacaaaattgacaaacctttagctagactaataaaaaatgagagaagcctcaaataaataaaattataaatgaaagatgtgacatgacaactgacaccacagaaatacaaaggattataaaagattattactatgagccattttacaagccaaaaaattggataacctaaaagaaatggataaatttttagaaacacgtaacctaccaagactaaaatataaagaaatagaaaatctaaacagaccactgagtaaggaaattaaatcagtaatcaaaacttccccacaaagaaaagcccagaatctgcttgcttcaaaggtgaattctaccaaacgtttaaagaattaatgccaatccttctcaaactcttccaaaaaattgaagaggagggaacatgctatggtctgaatgcatccctcaatattcacgtgttggagacttaatccacaatgcaagagtactgtgaggtgggacattttgagagatgtttaagtcatgaaggttctgcccttatgaatggattaacgccattataaaagggcttgacagagggagtttggccctttatgcctttgtgcctttggctttgtgaggatacagccttcctcctctctggaagatacagcattcaaggtgccataatggagcagagagctgccctcagcagaggcaggcactttgaattggacttctcagcctccagaaatgtaagaaataaatttctgttctttacaaactacccattctcaggtatgttgttatagcagcatgaacaaacgaaaacagaatacttccaatctcatttacaaggccagcattaccctgataccaaagccaacaagaatactacgagaaaaaaaaattacagtccaatatccctgatgaatatagacgcaaaaatcctcaacaaaagactagcaaacagaactcaacaacatatcaaaagagtcatacttcatgatctagtggaatttattattgggatgaagaattgttcaacatatgcaaatcaataatgggctatgccacattaataaaataaaagataaaaatcacaggatcatcccaatagatgcagaaaaagcacttatcaaaatttatcctttcatgataaagactctcgacaaattgggcataagatgaatgtgcctcaacataatcaaggttatacatgataagcccacagctaacttaatactcaatggagagaagctgaaaacttttcctctaagatcagggacacgacaaggatgcccacttttgccacttcttttctatatagtacctggcgccttcttttcactttagtaccttgctacaattaggcaagaaaaaaaacaataaaatcatccgaatctggaaggagtaaaattgcatctgtttgcagatgacatgatcttaaatagagaaaactctgaggggagggaccaagatggctgactggaagcagctgccgtcagcggcaccaggaagaacgaaaacggcaagtgaatcctgcacctccagctgaggtatccaggttctctcatctgggctgactaggcggttggtgcaacccatggagagtgagaaaaagcagggtggagtgacggcccactgggagctgcacagaacaagtggagctctcacccccagacaagggaggcagtgagtaattgtgctaccctgctcgggaaaccacgctttttctatgaacctgtacaacctgcaaatcaggagattccctcatgagcccatgccaccagagccgtggggcccaagcaaagagctgtgcagacactcagcagccactccggttgaagccagtggcagcaggctggagactgcctaagatgaccaagttcccaaggggaggggcagctgccacagcaaaccatagcagccctatagaagacgggcctgactgttaaaagagaaacaaacaaacaaaaagcaacaacgacaacgacgtcaataaaaaagcccctacaaaaaccccatccaaaggtcagcagcctcaaagatcaagcaaaggtagataagcttacaaagatgagaaataatcaacacaaaaatgctaaaaactcaaaaacccagagtgcctattctcctctaagtgattgcaatacatctccagcaagaacacagaactgaactgaggctgagatggatgaactgacagaagtaggcttcagaagttgaagaataatgaacttcactgcgctaaaggagtatgttctaacccaatgcaaagaagctaagaaccctgataaaacatcacaggagctgtgaatgagaataaccggtttagagaggaacataaatgacttgatagagctgaaaaacacaacatgagaacttcacaatgcaatcacaagtatcaatagctgaagagaccacgcagaagaaagaatctcagagcttaaagactgtcttgctgaaataagacagtcagacgagattagagaaaaaggaatgaaaaggaaggaacaaaagctctgagaactatgggattatatacaaagaccaaacttatgactgattggggtacctgaaagagatggtgagaatggaaccaagttggaaaacatacttcaggatatcatccaggagaacttccccagtctagaaagacaggccaacatttaaattcaggaaacccagagaaccccagtaaaatactccatgagaagatcaaccccaagacacagaatcatcagattctccaaggtcaaaatgaaggaaaaatgttaagggcagccagagagaaaggtcaagtcacttaaaaagggaagcccagcagactgacagtggacctctcagtggaaactttacaagccagaagagattgggggccaatattcaggaaattgaaacaggaccccttcctcacaccttatacaaaaatcagctcaagatggattaaagacttaaatgtaaaacccacaaccataaaaaccctagaagaaaatctaagcaataccattcaggatataggcatgacaaaacttcaaaagcaattgcaacaaaagcaaaaattgacaaataggatctaattaaactaaagagcttctacacagcaaaagaaactatcatcagagcaaacagacaacctaaagaatgggagaaaatttttgcaatctatccatatggcaaaggtctaatatccacaatccacaaggaacttaaacaaatttataagaataaaacaaacaaccccattaaaaagtgggcagaagacatgaacagacacttctcaaaagaagacacacatgtggccaacaaacatatgaaaaaaagctcaacatcacttatcattagagaaatgcaaatcaaaaccacaatgagatactatctcacgccagtcaaatcccaattattaaaaaaatcaagaaacaacagatgctggtgaggctgtaaagaaagaggaatgcttttacattgttggtgggaatgtaaattagttcaaccattgtggaggacagtgtggtgattcctcaaagacctagaaccagaaataccatttgacccagctatccttccactggttatatacccaaaggaatataaatcattctattataaatatatacgcatgtgtatgttcattgcagcactattcgcaatagcaaagacatggaatcaacccaaatgcccatcagtgatagattggataaagaaaatgtgatacatatacaccatggaatattatgcagccataaaaaggaataagatcatgtcctttgcagggacatggatggagctggaagccattatcctcagcaaactaatgcaggaacagaaaaccaaacactgcatgttctcacttataagttggtgctgaacaatgagaacatatggacacagggaagggaaaaacacccactggggcctgtggtaggtggtgggggttgggagaacatcaggaaaaatagctaatgtgtgctgggctttaatacctaggtgatggattgatagggcagccagtcaaatacccttttattgccatcgggcagacagcatctattatgtacttctctaccatcctcaccctcataccactcaccagcctaattgcaaataaactacttaggtgatagattgataggtgtagcaaactaccatggcacatgtttacctatgaaacaaacctgtacatcctgcacatgtaccctgaaacttaaaataaaaattaaacagaaaaaaaggaaaaccctaaagactccagtaaaaaagtgttcaaactaataaacaaatccagtaatgttgcaggatagaaagttaacttgcaaaaaatcagtagcatctctatatactaacaacaaactatctgaaaaagaaattaggaaaacaatcccatttacaatagcttcaagacaataaatataacaggaataaatttaatcaagaaggcaaaaggcttgtacactgaaaactataaaacattgctaaaagcaactgaagacacaaataaatggaaagatatcccatgttcacgaatttgaaaaattaatattgcttaaatctccatactacccaaagcattctacagatgcaaatcaatctctatgaaaattccgatgtcatttttcacagaaatagaaaaaaaaatcctaaaactcatatgaaaccaaaaaagaccctgaatagctaaagcaatcttcagcaaaaaatgaatctggaagcatcatgctacttgatttcaaaatatactacaaagctatagtaatcaaaacagtaaggtgctggcataaaaacaaacatacagatcaatggaactgaatagaaattccaaatataaatccatgcacttgtagtcaatttttctttgcaaaattgccgggaacatgcaataggggaaagagaatatctttaataaataatgttggaaaaactggatatccatatgcaaaaaagtaaaattggacccttatctcacactacatgtaaaaaccaactaaaatagattaaagacttaaatacaagagctggaactgcaaaactgcccaaagaaaacataaggaaaaagctttttgacattgatctggccaatgatttttttttaaataaaaccccaaaacgggtagcaaaggaaaaataggcaaatgggattgcatcaaactaaaaagcttttgcacagcaaaggaaacatagacgttgaacaccaaaacagatgttacaatttttcttcaaccatcacatacgtgatttaaggaccacaaggagaaagatagcttgttttatttagtttatatgcagtttattattaattactttgattttttttccattacactttatttcctttctgcttggagagcttcctttgccattcttttagacagggtctccctctgtcacctaggccggagtgcagtagcatgagcatagatagctcagtgtaatgacgcacctcagcctcctctgagtagctgggattacaagcataagctacagcactcatctcccttatagctattctctaaggggagatatatagatacatatatatctatatatgtatatagagatgtatatatgtatacatatacatatatatctatatatgtatatataatatatagatgtatatgtatatatacatatatagatgtatatgtatatatacatatatagatagatacatatatctctatatagagagagatatatagagagagatacatatagatatatctctatatatatagagagagatatagatacatagatctctatatatagagatatatatagatatatatagagagatacatatagatatatatgtatctatatatctccccttagagaattttctaagggtattattttctctgtgttgttcagattaagtcctattgatctgtcttcaagttcagtgattctatcttctgtcatttccactctaccgttgagtccttccagtgaggttttccacttcttaaatgaacttgtaatcactcattcaatcaattttatgataattgctttacagcttttgtcagataattctattatctgattcatgtcagctgtctttttctcatcaaaattgtgatttttcttgtatgacaggtttcttggtataatgggttattttcttggtatgacaggtgattttctattgtatcttggacattttagatatatgtttaagaggtggggtttttttcctatttacattctatgtatatcttttacctaataggaagtcatctgttttggtttagcatagtagttcagtctgaccaaaggagtggaagagtctcctccccgggtcactgatatcactgctaggggcagagaggctctaccagcagtttggggctggtgatagattgagctaccctggctctgctgatgaagctgctgtaggcatcctgcgctcaccacttctggcagatgtaagacaggaaaatgggttggcttactgagggcttggctggcaacatttctgggcagactgggccattactaaatcccagttgggcttctcctgttccactcctttggccagagaaagcaggcattcccttcccctttcttccttccttccacctttcctctctcactttctccttcttcctttccctctttcattccttccctccaccaattcttgctggcaattcagggctgcagggctctccagtgcccagtaagatatatatgggagatgggaagaaaagtcaggaaactcaccatgatgccgttcttcaagtcctcaggtccctagccaatccactttcttctttactacctgtcaaagtccttttatgattgcctgtcgtactattttcaggtactcaattgtatttggagggaaggaacaagtattagtgactttatgacaccctgttgcagaaatggaagccactaaatactttttaaaaacagattatttttcacttactctttgaaaataccatcaatgatttaaagtgaaaagaagcaaagtaacttgattaaggtgacccagcaaattagcggcaaagtgaggttcacactcagacagactcaagaagccccagctcctgcttcaggctccacacaactaccccaggagtcttttagagaaggaactctcagcccccttcctgcacctgcacatatagttatacattcccacgagatgaaggagggaaaagaactagtttctaactggggaatttagttgtttgcaaaacctgatcttccatttcagattcattcccaaatgacataaagctacatgggaaataaattcaaacacattcaagccaactcactgtgttggtaaatattctgttggctgaaatgccaaacacaaagcgaagaagaggagcttcctaataccactaagatctgcattcctatcgtggggctggcacataggaggttctcagtaaatattcctcaactgaaaacaaagtgaaccagccgtttaaaacactggataaggcttggctcatatacctcctaccaaacagtgtccctgagaacaaccaaccacatcatgacaccctgtggaatatttgagatactgcactatacaagctctaccaaagcccaaattcaaatggacgggtgaaagcagaaaataagaccgctccccaaagtgcataatcaatgtttaaaggtctagaatgctcttttatcgtcagcagtctgacttcaatgaataaggtactctaaaataaaagtagcggcttcccaattctcggtgcttaactgaatttcagatcatttatacaattcattttctcttaaaactaattttaaaatgtggtcgaaacccctaaccaagacaacatgtttccaaatggtaaggaattttgtgtaatttttcctttagacataaaatgaacaggcagcaaatttaaaacatccccaaattgtcctaaaacggaacatcctgaaaaagtccaatgatggaatggcaggcaaaatccaaaggagcttctagaaatattttatgatttcaaaatattaataagtgattactgtaggcaagatcttcatggtttgctaaccgtggctaaacgtattgagaggatggcagagcggccaagaggtctggagcccgcaaaatgaaaaaaactcctaatatagtgtaaagtcatttctgctggatatcgtgatagtcagaaagaagatttatttttgtttgttttccatataaaaacctgaagacctatcaaatttagtatgtaaaatattctagtttttcaacattttgtactccccaaataaaataaaaagcagagtgtacacaaggggatcattgtgtgtggcaaaagtacatttgcacacattgaacagaaaatgattaagaattttttatggcactaattttattggaaagtcatagctatatatgttatatagcgttgggatcaagtttcaaccatgcatatacctttcatttgtaatggacttctttatttattcaaatagtgtctgacatcagaaaaattggactgcttatcggaaacacaagacactcagaaaaaaaaagaggaattaaaaaggaagcaataggacaagtaaaaaaaaatcttttaaaatctttaaactctcatgaaaaccacatgcaaatgactgattctgagaaatatatcacagatcttccacagattttcgttaatacattttcttttaatactcatacgttcattttctaccctctaactctattctaaacttataagttagttgacaagatagtacctgcctttcatggttgctttgttactgtttaattcctcatctacaattcaattgcaactaactttaaaattcaaacacatcatctaatctttgactatttaaataatgtatattttagtaattaagatttgtcagtaagatcacttaaaaaaaatcattaaactcttcaggataaaagtcttttcttgtccacacactgtcaataaacaaagtgctaatcttgtcactttcttggccactgtctcaggaatgcttcttaagtactcaaaggattaaattaaatctcacctgcagacaggctttacaattcggctgaaaacctagttctcaaagtaaaattactttcattatcttaagttaaaaccaaatattctgtcctctgggatttgcaggaaaaagaacagcatcaaagaaaacaattcacttcaagagagtttgttcttcaagactctgtctgaaagaattatttaagggagaattcgttttgggaaacattttttcaaggtcattctaagacagctataaaactgtgctatttaaattacttcaagttgatgccttttcacaattttgactgtgttcttggggttttaggatttttttttcaagaattatttatgtatagtccttgttttgaattctaaatttggttatgatcttttacttttttaagagattatgtaactttatgagctgaacatttgaaacctatggagggaataaaatgaagagatttatttcctttgagttcaaaaatgaaataatagaataaactaaatttgagattaaaagtatgtattcatttggggggaaaattgtagcacttcagtactcaagaaactattttccaacttaaagtactctatctatgctctttaatttaatttaagaaataataggataaaatactcatattgcagaaaatttcctcttaagaagagatagcatttcaaaaaatccctccacaatgttgttataagagtcaccgggggcaggattaggacgcggttcatttttggactcttgcatctacttcctaaataaacaaatcctaactctcgctccccaaatcaaatacaaacccagaggaaggacagggagatgaactaccagactgaaaaatagaaacattatgtcaaagcaccctacatcgttatttgcagacaatttattttgttattgcttagtatccttcatgctaaatgttctgtcccctacagcaaatgttccatttcaaaaacatagtaacatgtgctagaaatagaaaccaccaaagcaatagttctagtggatatagaacgtattttatggtagattagaaaaatatactttaaaactgaagctcactatcaatataatctataaaataacctaagagtatgttagaattcttttttagttggcataaagttttagaaatagagattaaagtgcattttaccctcatcagactatctctaaaagagggcggttaacatgcaagaattaaaggcaaatttgcaaatttactttttattttcattttagaaacatcaagaaatgtaaacagaaccgtaacacttcttcaattagattcacaagcatgacctgtgggaagataatttactaatttagcatgttttttctttgacctgtgcatttgagtctttaacagtgtgttctacctacatggcaagacataccacagccttatctttccagagcccagttttgaatagccctgataagcacctcaaagatggatcctacctgtgccacaaatccccttcacttcagatgcgtttctatagggaagtataatcttacctagcattctgacgaaagccacggtgttgcatctaaaattcacaaatgctatacggtaactttgagcacctttaaaatttatatcaaatattttggaaactaaacatgaaaggatttctggaaattaagagtttccatgaggttaaggtcaaaaattcctctcaagaattttttgtgacacaatgacatatgttattcattggaacaaagtgatgggtggacagaaagcccataagaatataattcagcaacttctgagacacaccagcacccaaatgatttacacaattctatacagtcaggggatcatcatattcctatcactcaccgtggtgtgatgaatcacacacctgcaaaaaatatactcaattattaaaatataaaaattacacaaaaatagcgtggcttccaaatttgactgcacacgagaatcatctgaatacctgataatgcagattcctgagcccccgactagaagtgctgacacagtagatccagggagaggtatggtaattcacatgttaaacaagtgctacaggtgatttttgatctcccagtcccatgaaccagagctctggaaacacttgcactgaaacatttttacatcaaactgagtctggaaaataatagttactcccaatttctccctcaaccatcacccttttcaagaaaaattgacaatgttctccctaagtttccggtactgaacttatttttcaaaggtctgagaattcagaaagcattattcactgccatttaggagatacccacaggacatgggtccaggaagaagctgggggtgagaagggttggcgagtaagctcctcctcccttgcaccttccttaagaacagcatagacatcggtggtatttacactgataagggcatctttcatgagaaagcaaagggcatgcaaagattccatctctgtgaaaggcttcttcaatgggaagtcaccagttacttatgacaatcatatccatagcctatcttcacttagaacccattggaggccaaccataaaacaaagaggctgaagatataacaaatacccataaaataatgagacctgataaattctaatggacagagtgtcagcataaatgaaacaaattctgtatattctttgcctctcaagttcctggcaaaagaacttcatggaatctcccacttagagagaagaggcacaaaaagatcatgagcagtcaccctgtaggcctgtgatctaaaccctggggctggacagataagctgaaatagttaagaaaccctttcattttcttcctttcaaagtttaatgttgttcattccttccagcagtaaccatctgcatttaagaggtctgattacagcacatgcagaatttacaaagtaaaataatgatgcaggccccagattcattccgctagtggaaaggagtctgtcttctgcaaagtgtcaaaaattcagtctcatctgctagcctgacgctgaagaaaacataaacccgggcttcttttcccaattaaattcagggtcccttaaactttcctaggaggctagtcttgttctgaaatcggatatttaaagaagcaatctgcttttgtctatgcatttttgtttcctattaagatccagaatgtgttttgttcttttattgtccaaggcagcttctccacatgtaattttggaatctcacagatcaatgtttcgggatggccatcaacaacttctatgctttgttaacaaattcctctggtcctttaataccactggatcctgtccttaatcagagcatatgtttggggtaagtgatgcaaatccagatgtatccataggtgccatactgcaggtcactgcaaaattccctgcaaaagcatattaaaatgcaaggggctgctataaggcatcaaggagtccttctagaggaaaaaggccagagttcataagccagatactttactaataattagttaaaatgtacaatgaaccaactgtgaaaccaaatgcagtgcttaaagcacacagggtatttaaacaagccctgagaacaaaatgaaggaggaaaatggggaatatttgaagtgatacacccagggagaggtgcaaggaatgactagtagttttgttccaaggtagctttcatactttcaagtacttttttaaaagaaaaagatagctgtaactttgaaaaagaaaagcaatttgcctttatgcttacatttccacaggctctcccgtagatttcctcctttccatggttcagtaattgctggcaagaggggccacttgcaccctcaaaataaggggcaagtggctaattatttctgtacaagcccatgttcacattcagtcagttgcagatgtagaattgtacccacaaaaaaagaagcagcttctatattatagggccctagatgcagtggaattccaagaaagcaacacaataaccctgcaattcatggggtggtgaatccctatgtagtaccccaaatgggctgcctggtgattttctttaaaacaaattaataagaacaattttttaaaaagatttaaagatattcagatgatattcagataagcaagtcaaatctgctctcaatacttatgttggtctaaatattaaaccgtaaattacttcagtgttttgtctaactctaactcagccttctttaaactcaggaacagagggggcaggaagaagctataagccaagagcaagatctcccagtgccaggcactgtttgctgattgaatctgcgtaacaagtctatgatttggtgacaatgatccctattttacagacaagggtcacattgctacaagacagcaaagtaagacttgaacccaagtctctcacattctaaacacagtgcttgctttgttaaaaaccatagtcatctgcccactactttaatttttttttaatatctaatgtgaattggccaatagcatgctcaagaacagctcttctgtaagcatttacttcaaactggtctgactacatactattagcaccgcaggtccagtctcagtgagaatcaaatagtttcaagacagcataggaaaaatgtttcattaacaagaaaatcaaagcatcttccttctcaatatgcctggttatatgttttttgattcattcagtattgagctaatatttgtttaattcctcctgtatgccaagtaacctctgcagacctggtgaagaagccagactcggtccctgcctctgtagagcttgtgtacaacgggggacacagtcaataaacaagtcaacaaatgcacacaaaatgtagtaacttcagacagtgataagtacaaagtgctaggtacaaaaataaaccagttcagggaacagtaagtgatgggggtttgcagctgagttacgtgagatgggtattcacgaagacctcttggaggaggtgatatctaaggagagtggtagatgataccaagaacctgctggggagaactacaatgcaagggccctaaggcaaaaaggagttccaaatggccaaaggggggcaggcagtacagaggaggccagtaaggcaggcatagcccagatgatagaggatgttggagaatgctaaggacctttattctgaaagcagtaggtggctttagcattttgagcatagagatagcatgactcgacttgtgttgacaaagatgaggctggctgctgggggtgagcgcatgctaaggacacagtgaaagcagaaacggctgataggaagcccccacagccaagcaggcgagatttctgtgaagaggtgccccatgtgatcatgactggaccactttaacaggtgaaggaacaaacaactgcagttcacccatgcaatggattattactccacaataaaaaagaatggtctactgatactgtgaaggttaatactgagtgtcaacttgattggactgaaggatgcaaagtattgatcctaggtgtttctgtgagggtgttgccaaagaagattaacagttgagtcagtgggctgggaaaggcagactcaaccttaatcttggtggataccactaatcagctgccagtacggccaggatataaagcaggcagaaaaacatgaaaaggctagatttgcttagcctttcagcctacatctttctcccatgctggatgcttcctgctgtcaaacatcagactccaagttcttcagctttgggactcacactggcttccttgctcctcagcttgcagatggactattgtgggaccttgagatagtataagttaatgctacttaataaactcccatcatatatgtgtgtgtgtgtgtgtgtgtgtgtgtgtgtgtgtgtgtgtgtatcctattggttctgtccttctagagaaccctaacacagatttccacaactatacagatgaacctcaagtacattatgccaagcaaaagaagctagacccagaaggctacatatctatgggtccatttatatgacactgtacaaaaggcaaaactattgggacgaaggagcagatcagtggttgccagggcactgaggctgactgcaaaggggcatgagggaattctagaggatgatgaaactgtcatatatgttgattgcagtgatggtcatgggactgtatggattttttaaatgcatagattgtacaccaaaaaggaggaatttaactgtatgtaagtaatatctcaagctttttaagtgactagtaaaacatgcttatattaataggtttaaagattgtaccactaagactcaagggaaggacagagcccatggccatgcagctatttctatacaactgtctcagtctgggacgccctccagttggatctgggatctgcaagggaccagagtagaaacaagctggtggattgttgaggctgttttgtctcagtttcataagcaaaaggcaatggaaaagtgttggggtcaagtgtgaaatgcgtgcgtctcctacaaaaccttcccttagccctgcctaattcgccagcctcctttccaccctgcctgtttactccagtcacactgaagtccttgaactgctaagctccacaactccaccctctctggctcagcaaacaccttgtcttcttttctcctttctctgaaatgctacatcctgtccttgacaagggaagagtcctcccatattctctcaacacctgtactgcttcatcatactccctgcaactgcagtcaggttattaactctggaatcttagcttgacttttgtttactgactaattttccattaagccaaagctccatgggggcaaggactccatctctctcattccagactgtattcccaatacctagcacatacatagtaggccctcaatacatacatgtgaaatgaatttcaataagttgctcattagaaatattaggtaggcagaagcagctctggaacagctccttgattcttctaaagtagtagttattagggaaagcacatgagaaactcatataaggatttcacagaggaaagcccattccccacccattccctgatgcctgcagccagaggtcctgaaaagtactttctacccaacagaagacacaggcaggtgggacctatttacagttcagaatgaagcacttccctgggctgtaggctttaccagaactttgctctgcttgttgggaaggaatgcaattcatgattcatacattcaataagagacccaagaataattttccaaggcccacttggaactcagataagtgctagaatgaaaacatttaccagcagattaagatggttttaacatttttcatttcaaacccctatttgcaggggattacatgataagccagctgtaaaacttaattctaaactgaaacttggcaaataatgatggactgccttcacacatattttttagaaaaaaagggggtgggagtgcagagagagagggagacaacctttggtcacttgtaagatactgaaatgccaaaaaagaagaagtgaaaagtcgttttcagtgtttctttaaatcatccttgcagagagaagatatctttgttttcaacatcaatcttgagaaccagagctcagagatgagaccagacttaagcaaaacaggacactgacttccatcaacaccatacactgggcagctaccccatctctacttaaaatacaaaaattagccgggtatggtggtgtgtgcctgtagtcccagctactcaagagactgaggcagcagaattgcttgcacccaggaggcagaggttgcagtgagccgagatcgcgccactgcactccagcctggcgacagagtgagactccatctcaaacacacacacacacacacacacacacacacacacacacacacacacacacacaaatttaacctggtcacatttatttgtcagagttagtgtcctaagatgtagaaaatagcaactcctgctgttgtttagacacaataaattgagtataaactatgttctcttaggtccttgtggccccagagagaaaaccagactttgagaaatataggcagtgcatgcactgtccacttcgctttaaaagaaactacaaaaaacagtcacacaattctagtaatgtgctgttggcccagactgtaaaatcccagcatgtctccaaccaagttcagaggaagcgccatcaaggatgccctatgggtagcttaacagtcattgcagacctgtttgctctgtgaaaagctacaagatgctttcagccagaaaaagaaaaagaactcaaaatgatgtggccacatggattctgtcctggattctgttctcaatccactttaggttttagagacattaaatagagagccagtattacgggaaaaggcagcagtatgctaatgcgcagggtcagcaaactcccgcccacaggccagtttccggcccaccacctgtttttgtaaacagaatttattgaaacccagccaatatctatacttgctgtagtactacaaatggcagaactgaatatttgcaatggaggccatctggccctttaagaaaacatctgatgaccctcagaccagtgaatatgaggagatatttaaattctgtgtgtgttgggcaggttagctaatgtctttgagcctcattttatccacagtaaaatgggataatagtaacacctatcccagaaggtagttatcgcagctacaagagttaatgcaaatgtagaaagcaagggggaaatggaattttaagagctgggacccgagttgcattttgagagaagtgttgctgttgcttagggaagtatgaaccactattagtagtactaatctttcccacataatcataggactgtcagccctaccctatctgaaaatagtggagttgaagtgtcttcatgctcctctgcctcctgacagaccacacctccagcctctcatctttcccacactcttcaggtggggtaggactgacagtgtgaagaaaggtagtcaggtgggccaaggaaaaaagtaggtaagggaagaagctgaacacatggcaagctgctgaaacaagcaggcaaagtgactgatgaaaaactccacatggcgaggcagcaccagctttgtgcagaatcaaggaagcctgatgctccactttctcaagtcctccttgttatgattataagccctgctctcccaacctaaggtttcaggaaagactgctcagcccacatgccttgtgtgagtggtaagaggagaagttaaagggaagaggctgtgtgccacgagtgggtaaactgaacaaccagacccacagggaaaagaggtgtaagtgagcagtataacggggatggaaattcacacctggagggcattctggaaagaggagactgtgagggatggggagaagtggggaggaatgggcttctttctggatgtggggtagaacatgtaagctgtatttacatctcaaaggacaggatgacctcaggtggcacccgagttacacacatcaagaacttagctcaacaactgacatataaaacattttcctgatcttttacatgtccttgccattacaattattgttggaatcattatttactggaagccagaaaacttgattcccattgcttttctatctcaggatctcaatcaagccgtttagccactttagaacctcagcttccttatctacaaaaatgggcataatagctgccccgatgactccactggatttacggaagggatcaaatggaaaaacatgtgtactatgaaaattataagtccccttcgcaatgtaaggtggcatcattaagaagaagttgactttttttttttaagtaaaaccttaaccagcctaacccttaaaaccaaaacttcaaagctcttgaagcagtttacatttctcccctcttaattccaggcaataaaactgtaacctcctcaaagttacaggagatacaaagacgcagacagaccagctgcagctcatggtccacccccaccccgaataggctgagatcatttattcaaaagcacacctttgaatcatctgtaaacacttccttcaagttcccagtaagttaaactttgctaacagctggcaattatatggcaattattacacccattttgttcttaggcttaaagttatactctctggaaaaacagagaatgatataaagttggtcttttactaaaattgtgtacagtacctgcctcccgacccattgctttttaggaaatgtcaggcagtgcttaaagagaaatagcaggactgtgcccacacatgggccagagtgatgaatctgctttgaattggaataaggaaaaacaaacatcgttgaacgggggagatttagttcaagggtttcaaagtaaaaattccagagatagctccatttcaaaccactgcacccaattttgagataacatatgaatgaagtctagatgtggaacatgatgggaatacagctatattactgaataaatgcctttcatatatatgatagcatatttaaatatgattggctatataacgtatcaaatgtctattacgtcctatcatctctgttgggtaccttgtcccccctgctggatacttttaacatccattgtatcatttcattctcctaataatcctatggaaaagatactgtgttcttattttatcgatgagcaaactgcggcttcaagggatacaacaacttgactcagtccatacaactagtaagtccctagttcaatatactgtctgtggataaaatatgggtcatctcttttagaaaggcatttacaatcaagttgctttgccaacactcaagcaagcaagttggagaaaactgttgcagtaacaatcaaaagcctgttttcaagatgcttccatttttattaagtcattcaaaaattgccctcatgctctgtatatgtagtcttatatcaaaaagcgattaagatctgacatgggccaaatgtcggtcttcagaggctcacagccctcatggcagtgcgatgtaattcaatattgcaacactgaggctcggaaagacaatgcgcgtgttaggttgcagcattcattacctcaggcgagacacaggccctctgtgtatacactatcaaagccccactaaacttaaactgaaatgccaaacacggcgacctgggccccgttaatcaacatctgctcaacagtttgcctctttccaccagctagcaaagagaatgccatacagcttttgtgctgtaaaacctgggtaggctgaaagaacaacctgagctggtgccttctagctgggatggcagtattccctgatggggagggcagacttaggggagaaaagacagtcatagttgcctttgagtttcagagattttcactcccagcagaatagcaaatgaagcaagtcattttcctcccttccaaggagtgatatcacttttttttcagacaataaaatacatggaaagtgaaatggtttgattatctttagcaccagtaaattttattgtaatccatggccaaatatatttatgtctggttctgatatacaaccttagctcctattgttcagaggaaattttacttaaaagacgttagtcattaagtctgccctgaagagctcaagcagagcttttcctactagaatgtcccgtataacaggcgagacagacaaactgcagaggtaatggaggctggcttccaaatctgccactctccgggggcctatcagccccatcattagtacaacacagctgcagagagactcttcttattttcagtgaattcattccatcccaacttcttggccaatcccactctcagtctcccctctctctatctgcacttgcatgccctcatgctgagaattgccacattgtggttggttctgtctgcccacatttcaacaacaaataacagcctgggtggctccaggtttcatggggcctgaatttgataggagtgtggaaggggggtttctttaaagaaaaatcttacttttgcaaaatttacaaaaacataaacatgagaatacactgccagagttttggaagagacttgtgcaaaggagggggcatgaacttaagcaccattagctttccagcaaattcatctctggtatgtaataatgtttactgagtgatgtccacataaccctcagtccatcctgtctcaccagaccaagagcttaacctttgccatgtgacaattcttccttcatctggagacaaatgcttttgaacacctgtccctagaggacataaggtttggtctgctcaattgctaagagataatttatgaaagtccccataaagagagggaaagaagacatgaaatgtcatttggtctttatagtttcctcaatgtcatgagggtgttgcatgcttgctatgactttgtttctcttgagaaacaggagaaacctacttctcagtgccccagataagaaaggaaaagttacaactcagtggcctctccaccaaccacctcagaaaagaaagacacaaatgaacaacactgaccaggtcatgtccttgaagctgatctggacaaaatctgtttcccaaatatgtatgtattatgtatcatacattattatgtatgggccttgtgagagagttggggcctcctagcactacttggacataggtgtcaatctttaagacctgagagatctgtgctggtaatagctggacgttacttaataccctctgagttgagaatagacgagatgatgtgacaagtgctctctgaccggttttggtctcttagagctctcaatcctgcacttaactgctttattgaaaagccaatcaatatattaagagactggaatgaatgaagacaccttccctggtcaataggcatactcttttttaaaaaaggattcattaggcgccagttattgtactgagctcttttcactcattctccatgaatcctcatggcttctctacgaggtaggtaccatgatcatgttcattacagatatgggggcaactaaggttgagaagggtaaggaacttgtctaacctacatagttaaaaaagagataagccaaaatttaacctcaggtcttttcttcctcccatttccccaataagatccttttatttcttaccttctcctccttcccccacaaacacaccattaaacaatggctctaaatcttaacacttattttttatattttatttctaattacagtaaaatatacaagcaagatttaccatctcaaccatttttaagtgtccacttcaggggcattaagtacattcatattgtttgctgtgcagtcatcactgccatccatccacagaatgattttcatcttacaaaactaaaattttgtacctattaaataataactccttatcttaacatttcttgtttaatttttctttctttcttgtaatgtgtcagcatcaggccccacattgcttactcatttcttggttttgctttgggcctataaaatcttcagaacagttgtattcttcttaattagaaagcctccatcaagaccccagctgactgggttgtgttctggcatagctgcatggttctttcgcctaagatgtacctaaaatgcagtaccaaagcaacttcccagaaccttgttttcatctgttaaactggaatccaaacagtacctacctcactgacatgtgggtgttgtgaagattaagataatcattcattgtatttcacatgtattgattaagctcctgttacatggtggatgccgatctaggcacttgggatacgtcagtacacaaaacagacaatgattctgtccttataaaacttagattccaacagagggaggcagatgaaaaataaatataattaatgagtaaatgatagattgtattaaaaggtgaaatactatggttaaaaaaaaagaacaagtagacaaaggtaagaaatataatgatctacctctttagtttggtataaatattcaaatatgagaattttaaataacattacataatgttccacattaaattcttctccaattaattgattattatttgtcaggtatccttacagtgatataatcaatgtgattttcagagaagcacttgtaaaacaaatcttcaattcatattacaaatttctgtagcaagatacctgcacttgataaacagctgtgctctggttataattcctgatatccaaacatactcacaagttgtgactaccagaaaacccctcctgaacccatgcctccccttaacttttagggagacataccctgacaaggtagatgtacagacctgcaagtggtctctgtaactgttacgacccttggacttaatccaacggctggctcttgggaaagttgagaggttggaaaagccttaccttcaggttcacaaccttctgattgctcaccacaccacactccaggtgcctggtattagtgtcatccccaccaactctgccaccaccccaatcacttctgaaaagacgaagtctctcagtcctctggtgacatgtgactgttaattttatgtgtcaatttggctggaccacgacaccaagatatttggtcaagcattattgtggatgtttctatgagagtgtttttggatgacacatgaagtcagtggactttaagtaagcagattaccctccataatgtgggagagcctcatccaatcaaaacaaatggctgacctcccataggcaagatggaattcctcagcagactgccttcaggcttcatctgcaacatcagctcttcccggttcactagcagacagccttggactcaaactgcaactctttcctgggtctccagcctgccagcctctcccattagattctggattcacaaagtccccataatcacatgagccaatttcttaaaacaaatctttttctttctttctttctttatttacacacatcctattggttctgtctctctggagaaccctgtctaatgcatttggtctttccttctctaccacagaaactttggtccagggcccttacccactctccctggctaagggtcaatgaggggatcatagaaagccagaaaattataaggcttcatgtgctcttgtaatgtctttctccatgagcacataaagatatcttttttttattttttttatttttttttttggaaatggagtctcgctctgtcaccaggctagggtgcagtggcgccatctcggctcactgcaacctccgccccccaggttcaagcaattctcctgtctcagcctcctgagtagctaggactattggcgcccgccaacatgcccggctaatttttgtatttttagtagagacgggggtttcacctgttggccacggtggtctcgatctcttgacctcgtgatctgcccacctcggcctcccaaagtgctaagattacaggcatgagccaccgtgcccggccacatagagatatttatatgcacagataatggttaaaatccagactacttcagttcataacctattgctgctactaatcagctacaggaagtaagtgactttggacaacttacttcagatctctaggattcagtttccccatctgaaaactgaggtgtctttgggctcaaagattcttattttaatttccatctttgcccagaagtcctctctaaacaatttaggagagttggatgtattctctgtatttaagtcttttatcttaaatcatatcccattgtgccacatcacaattcttcctttagtgttgtaggaaaaaacaaaaaacaaaaaactgtgcttcaatagaaaataaatgttcagatcataccctttcaagttatctggttctagtcttttattgtcttttagctattgtacaacttggtaaactgtaaataaccgatggcaatgaaaataattcctgtctacaaacatgcagattctgagctgtccagtagaggttatattgactttccctctgcacttgggaaaaagccagctttgtctgcatttgcacattcatttcaatattcctgatctacaaatgtgtctgttctctgaattctctatccagttctaacatctgcctggttcctcagctgactaatgagttaagtaaaatctttaatatgtgttcattttataactgtatcaaagtcataattttaccattttaaaaaaattatcttagaatgagttctatctctactacactgggaacgtcttatgtacatttaatatgtttgctcaatgaacacacaaatgaaggaactgacaaacaaacatagtctttctcccatgggcacatgaagatttctatatccacagataatggttaagagtaaaatccagactacttcagttcagttacctactgctgctactaatcagctgcattatccacagcaattatctgtactttccttttcccatctgtaaaatgggaagaaacccccaccctttaaaggttgtcattaggattaaaagaaacaatccatgagaaagttttagtactatgcatggcagccttgtaagtatttaatgaattgtacttatcatcatttttagacaggttgaccatttgggcaatcatacacattctgtctttcatctaacaacccacagggtgccccatacccaacaggtgcttcataaaggctaatgacggtggcagtgaccacaacagttccaaaacctcctggcctgccaagcttaataaagtatgttatccattcttccagaccactgctggagatgttacagcctgaccttctattgatcccaacatcgtcccaatggaccctgttccattgtaatttattacaacagccaaattgaatccacatgacagtgctcagggccaattctcattgagggtctccccctcttctgcccctgcccctactgcccccaaagatttgtggagacactgaattagatgatttactcaattccagatattacagctattgaattcctttctttaatcttgcacatccacctagaaaacgataaagatggcctggcatgatttgttctgcactctcgtaaattttttattaatgcagagtcagtaacctccacttgcctgctcaattcttcccagccatggtctttatcttgaggaattcaagttgcttgttgctactgacatctcctatattcctcaagcctttattctcagttagaaagaagcaagtccagaaagatagttctctggctgcaggcacgactgcacataaataataacaggatctagcagattctacatgcaagtttgcccaaagatgtctgagcaaattagtgcctcctgtgctctataagacaatttcaatcgctaaaattgacattcttgatttttccttcaattcaacacagggatggtgtctcaggctctttctctattgaccttgtaagcatttcgaatgtgattttctacctcctgcttttctctctggactagactagtctgcatgctgacactgcaattgggagacttatctaaccaaactagtttgtcagctaccataacacttagcacagtgtttgtttagttcccatgtccttgatcatagagactctacaaaagaaaggaagggactttaaaagatgaattattcaaagaaaaaaatatttagcttaaaattctaaataaaggtcttgtggcaatgacgagaaaaaatatataaaccacacagaaacatacaacaaatgtttggactatgaatggaaatgaaatactaaaccaaagattcttcaagaacagtttctgagagtttaaatttgaacatagcaaataacatatatttccttatgacaattgccatgtttaccagaaatctaagttaaagttactgtaaacagaagaaatacataaattaccttgggtgcttaactaagttctgtatctgtaattcagtaaactgctataaaaagtattttaaaatggaggattaaaataatgcaaaggaaaattagctgatatacacgtgggtataagcacattaccgtgaccaacttaaattagcaaataaacatttcatgctatgtgtagaattttttctgcatttcatattataaaccataaatcttaattttccttgttaatgttaaatgtttattttgttcattggcttatgcaataaaaatagataactattttatatagattcaagagatcccatttttaaaagcctaatttgatttttaagaataaaaaggctatactgtttcttttttaaaagaagtataacatggtacttacatgtaagctaattattttaaaataaagaagtactattgctttagaaatgaaaaataaacaggataaataataaacggtaagagaactcttttcagttcaggcttcagggcaaaactgtacacctctgtacaagatctggtgtgaattttctgtggggatctgaagcttatcaggccaaacttacacatttaaaaggcttggccaattaccatgtatctatctgctctaggggtgaaagcagcatctatgatacctctggtcactctccaaaccattcactgcttactatgaatgctagaaaatgaagatggatttgcacaaactcatgctgattacaaaaaataataataatgatacaaggcccttttttctcattctaaaacaagaagcgctcatttcttttatttttaaaaatagttaaatgctatcgtttcagcacaacccattgcacacacatgaacacacacccaaacacacatatgcatgcctttccctgccctttagggagtttatcattagtataccaccagaattgttgaccctacctaacttcccatgtaactttgcaagtttaccatcaaaggctctggattctggtctcaactctgacttgagctcacctggggtaatgcatttgatttctggctctcagactagaaaatcttaccttctcaacagacggagactaggttgtttctccagtccttttcagtgccaacatcctaccctgccccaactctggcttcggaataacttcagggatgaaagacacatatggttatgacagagattgtttcataaacaacaaggttactctcagagttatctttaagagtatcctctttagaatgaactattgataaaagctacaacatggatgagtttcaatgcattatgctaagtcaaagaagccagacacgaaagtctatccatatacaggatgattccatttttatgacattctagaaaaggcaaaactacaaggcatggggaacaaactggtgattgccagggattggaggctggggagagagattgaccacaaagggcagcacaagggaggattacagaagtgccccgtgtcatgattgtgaaggggcttacattactttgtttttgttaaaacacatagaactgtacaccacaaaaagtgaatttcactattagtaaagttaaaaagcaattaaaaattatctttgtgaaataatttcattttctttccaagctcttaaaaaattgaggagtttagcatttaagttcggattttttgtataaaataataatttattgagcaccaacagtgatggtcagtttgttcattcaacaaatacctcttgaacacctactatgctgagaaaaattcagactgaaagtaagaggtgagcttatcctcattttaatgacagggaaactgaggcagaggatatgtaagtaacttgccaaagattaaaaagaccttaagtaacaacactgagattcaaagccaggcctgtcacagttcatgcccttaataaactaattatactgaagcatgcatgtatgtatgcataagttatgtctgtgtataaagtttttaaaataaaaatcaggttatactataaagtggtgttgagggtgtgggaaaataggcattttctgatacttctctgtacatacatattgtaaagtttatttccattaacaaaatagagtgaatatctttctatatcattaaatatactcataaatatactcatctataacatcatgtctactggcagaatttccatgtatgaatataccatcatttatttagttactcctccacttgggaatgctttcactgatctggaaaaaaaatttttttaaagaactatgccgtgaacaagcctgtagctaaatcaatacctacatcctcaatcttttcctagaatgaattcctaggtaaagaatcaataggttaaatagctctggtcaaatgccccatgtttgttttcccctgactacctgacatttcatacctgccatctacctgtcccaaagaacactaccgggcaagccctaagaaacgtgtcggtaacatggaactgcagcaaaggacctttgcctctattcctaccttcccacctggccacccttgtccatgccctcagctgttcacaagttcacagacattccatttggagacagccttggtgtgtgtatgccgcccttcataaacttttataaatcagtctatcatatgtgaccttaagaatttaacttcttattttaataactaaagaaagaaatatctccactccatgtcaatgagtgctattcattcaagcacatcctgtttgcttagctttgcttcattcagactttattcacaaaaaagctacagaacgcaacagaaactaaggaagacctcacccttgggaacgaacgacttacttccctttgcaccagaaaggatgtctgaggcaaacagtaaatatagtctggaaaagaagtgaactttgtttaactctattaaatatttagagtacacttttaaaatctcaaacttgccatgaaggttgctatatgatagagttgcctagaggctgtaagaacttgtgatctacaccagagttgagcaaactgcagcccatgggccaaactggcccactgcctgtttttgtaaataaagttttattggaacacagccattcctatttatttactcattctgaatccaaaaagaactttggacttatttatttactcaatctattacatttcagttttccagctaacatttattaagcacctataacatgccagcactgtgctaagtactaaggataaaagaatgactaagactcagtcacttcctttgctgaactcagggtttaatgaggagagagacataaagatacaacatagcattttaggaaatcttaggtattttatctaaaatactacaatctgaaagctgtaataaaggctcatttcctatgcatacatttttaaataatccgggtccccctaaaattgtaaaacatcatcaagactcccattatttattttttttctttattttatgagacagggtctcgctctgttgcccaggcttcagcgagtgtcatgatcatggctcactgcagcctcaacctcccggactcaagcaatcctcccacctcagcctcccgaacaggtggaactacaggcacgcactaccatgcccagctaattttttaattttgtgtagagacaggtctcactctgttccccgggctgctctcaaattcctgggctccagcaatccttccacctcagccaccgtgcccagcctcatgatattctgacatggactactttcttttttaaaaaaaaaaaagcattttattttaggttccaggatacatgtgcagaacgtgcaggtttgttgcataggttaatgtgtgccacggtggttcgctgcacctatcaatccaacacctaggtattaagcccagtgtgcattagctatttttcctgatgctctcccttcccctgtgacccccctgcccctactgactggccctggtgtgtgttgttcctctccctgtgtccatgtattcccattgttagctcccacttatgagtgagtatatgtggtgtttggttttctgttcctgtgttagtttgctgaggatgatggcttccagcttcatccatgtccctgcaaaggacatgatttcattcctttttatggctgcatagtattccatggtgtatatataccacattttctttatccagtctattattgacaggcatttgggttgattccatgtctttgctattatgaatagtactgcaatgagcatacatgtgcatgtatctttatagcagaacgatttatattcctttgggtatatacccagtaatgggattactgggtcaaacagtatttctggttctagatctttgaggaatcaccactgtctcccacagtggttgaactaatttacattcccatcaacactgtaaaagcattcctatttatccacagcctcaccagcatctgttgtttcttgactttttaataatcgccattctaaccggcatgagatggtagttcattgtggttttgatttgcatttctctaatgatcagtgatgttgagctttgcttagcttttcttcatgtgtttgttggccacataaatgtcttcttttgagaagtgtctgttcatgtcctttgcccactttttgatggggttgtttttcttcttgtaaatttgtttaagttccttgtagattctggatattagacctttgtaaaaggggtggattgcaaaagttttctcccattctgtaggttgtctgttcactctgatgatagtttctttttctgtgcagaagctcttcagtttaattagatcccatttgtcaatttttgctttgttgcaattgtttttgatgatgtcatcataaaatctttgtccatgcctatttcctgaatggtaccgcctagattttcttctagggtttttatggtttggggttttacatttaagtctttaatccaccttaagttaatttttgttaaagtataagaaagtggtcctgtttcagttttctgcatatggcctattttcccagcaccatttattaaataaggaatcttttccccattgcttgtttttgtcaggtttgttgaaaatcagatggttgtagatgtgtggtattatttctgagatctctattctgttccattggtctatgtgtctgttttggtacttgtaccatgctgtattggttaccatagccttgtagtagagtttgaagtcaagcggcataatgcctccagctttgttctttttgcttaggattgtcttggctacataggcatgggctcttttatggttccagatgaattttaaagtatttttttctaattctgtgaagaatgtcaatggtagtttgatgggaatagcactgaatctctaaattactttgggcagcatggccattttcacaatattaattcttcctattaacgaggatgaaatatttttccatttgtttgtgtcttctcttatttccttgagcagtggattgtagttctccttgaagaggtccttcacatcccttgttagctgtttcctaggtattttattctctttgtagcaattgcgaatggaagttcattcatggctctctgcttgtctattgttggtgtataggaatgcttgtgattttgcacattgattttgtatcctgagactttgctgaagttgcttatcaccttaaggagcttttgagctgagacgatggggttttctagatataggatcatgtcatctgcaaatagagacaattttacttcctcatttcctatttgaataatttctctctcttacctgattgccctggtcagaacttccaatactatgttgaataggagtggtgaaagagggtatccttgtgttgtgccagttttcaaagggaatgcttccagcttttgccgattcatgatattggctgtgggtttatcataaatagctcttattattttgagatatgttccaccaatacgtagtttattgagactttttaacatgaagggatgttgaattttatcaaaggccttttctgcatctattgagataatcacgtggtttttgtcattggttctgtttatgtgatgaattatgtttattgatttgcgtatgttgaaccagacttgcatcccagggatgaagccaacttgatcatggcagctaagctttttgatgtgctgctggattcagtttgccagtatattattatggattttcgcatcgattttcatcaggggtattggcctgaattttttgttgttgttgtgtctctgccagattttggtatcaggatgatgctggcctcataaaatgagttagggagaagtccttccttttcaattgtttggaaatatttcagagggaatctaccagctcctctttgtacctctggtagaatttggctgtgaatccatctgctcctgggctttttttggttggcgggctatttattactgcctcaatttcagaacttgttattggtctattcaaggatttgacttcttcctggtttagtcttgggaaggtgtacgtgtccaggaatttctccatttcacctagattttctagtttatttgcatagaggtgtttgtactcttctctgatggtagtttgtatttctgtggggtcagtggtgatatctcctttatcattttttattatgtctatttgattcttctctttttccttctttattagtctagctagtggtccattttatttatttatttatttttttccaaaaaaccagcccctggattcatgatttttttgaaggatcttttgtgtctctatctccatcagttctgctctgatcttagttatttcctgtcttcagttaatttttggattggtttgctcttgcttctctagatcttttagttttgatgttacagtgtcaatttgagatctttctagctttctgatgtgggcatttagtgctataaatttccctcttaacactgctttagctgtgttcctgagattctggtacattatctctttgctctcattggtttcaaagaacttggtttctgccttaatttcattatttacccaggaatcattcaggagcaggttgttcaatttccatgtagttgtgtggttttgagtgagtttcttaatctttagttctaatttggttgcactgtggtctgagagactgttatgatttcagttcttttgcatttgctgaggagtgttttacttccaattttgtgatcgattttagagtaagtgccatgtggcactgagaagaatatatattctgttgttttggggtggagagttctgtagatgtctatcaggtccacttgatctagagctgagctcaagccctgcatatccttgttaattttctgtctcaatgatcctatctaatattgacagttgggtgttaaggtctcccactattattgtgtgggaagactgccattatttctatgctgagcagtcaaggtattgaaaactgctttagttcctagcggtgccactttagtggaccagcagcattctttgtcagtatcctgtgaactctactactgtttacttgcctctgaatttccatgagaggtttgggaactctgaaaagttattttaacatgtacttacatcagttttctattgctgtatgacaaaatgccaccaaatgacttaaaacaacatccatttattagttcacagttgtgtaagtcagaagtctgtcaaggtgtggctggggtctctgcctgtggctggggtctctgcctggggtattacaagggtgaaatcaagacgtcagccagaagagcatctctctggaggctctagggaaaaattcacttccaaatccatcatattcatagtcccaggcattattcaaagcacatacaacagggaagtgggaaagctcaggggtccatcttagaattctatctaccacagtacttttgttagagttataaatgacttttataaaccataattgtattatctaaggactgattatatgtgggtgctactgctggttctcaaaatcagcaatctaaaaaggaggtatgataaaaatgttatgacaaaggctccaaattgccatatagtttgtgccattaatttagaatacaacttccatgaaaacagtctgtttaaagcagttacatattttagtctgcagaagttgtagtataatcaggtgagtacaaaggaaagtacaaagtacaaagactgcagtatcagaacagtagaaaaatgctattacccacagtaactgtgaagcaatatgccccacaagaacacattacccttactttacatttatacttatgggaaactaaaacaggtattatagacattttgaatcatggacttcccttacaatataacatgataaatgccaatatagatatgtgtaaaattcttcacagcaaagcagagtccattggcaaacaaaagataagtaaaaaaagacagaacattttccttcccacataaataaggttgatttaaatcaaatggcctgggagtatgtagggagaaaaacagaatcatctgcagactgaaatatgtaaaggctcaaccacctctaatcccatttcaaaaactataagcaatagctggcagcttggattgacagatgtgtcaagatgcctgtacccgttagggtagcagccgtggtcagggcactctgggcatttttattttaaatcttcaaggaattttgcaagtaattataaacaaaccttttttaaaaaaaaaaaaatccatcatagtgaaattgagtatagaatataaggtcttaacccagaagcaaatatttatttaaaagagaatttgcctcccctgggtgggatcagctttttcattgaacgagaatcaattctcagcatgatctggccctgaactgcatttttaaataacactgataattgttattgccacttgcaagtcacaaaggactagaacatttataatatagaagtcaaaatgactctccaactttaattataaaatatatttgattgctagaagacgtaaagaatagaaaagctccgaaatgtgaaatctgtttcctaagtgggccaagaaagtgtggtccagctatattaaattacttctaattccaccaaatgcaccgtgctgcctcttcctgccaaacctttgcaaatgctattctcgctttgactggaccactactcctagcccctcatctctcaatttagccattatcttttccaggaagtcctccttattcatcccactcccctggctaggtgaggtgcccctcctatgtgtagtatacctggctgatagagcacacatcatctacagtcctgtaacttgcctatttagtaattttctccatgagtctgagttcccagtgggcagaaattacaacttcttcaataatatatgtatccccagtacctttgaggcagccagctcattaccgatgctgaatgtggactattggatggctggacagcaggagggcaggcaaacaaacaggccagagtagggcaatggtgcccaaggcctcatatgccatagggacatggaaagaaggaaaggaaaagtgtaatcagattcagacacttgagtacagcccaggctctgtcactaattagctccatgaccctacataagtcacatcatccctcaggtactctatatcttgagtggagaaatgaagaggttggactaggaggctccatcaagtctcttccaggtttactgttgtctcatgtcttcctgtcttcaagactgtccaggcttcatcagcataaccaaagttacatgtcttttaaaatcaaataatattgggttgtgtacactagagcccaaaggaagaaaaatggagctatgtgaagacagtgcctgtagatgctgaatgaatggatgaatgaatgggcaggcttccctgactctctttaattgttccattagagggtaactttcctagctttggttcctttgataataaaataccatttcatcaatgtcatctctaggagaaggacaatttcaaatcccttagaagaaaagcaatgtatacaaaggaggaggctactgaatttgttgcttcacaaaggagcttagttttaccatggaagccacaatctctatccaagagacatgaagcacacacaaagtgacttttgaatatcattcattggagcaaaatggacttctgaccaacagtatcgatcaattggttaaagtcaccaagatgttttttcctaaaccatctcaccaacattggggcaaataattccagccaagtgcagcagccatacactgttggtgattacttgccctgtggaatttaattagcactagaacccttggcatcaccttcgcaccatgatgaagacacactgtattggatgtgagggcaatctggctgcaacatctgtcaccccattgatggccagggttgattcggctgatctggctggtaggcgggtgtccccttcctccctcaccactccatgtgtgtccctcccaaagctacatgcttggtcaaagaggacgacatccccaatagaggaggaccgatcttcagtcaagggcatacgagtagctgtgctcccctgttagaacccccaagcaagctgtcaagacacactgtattaaaggatgcaagagcaaagatgcctattcttaggtccggtgacatactgctaccctaccaacacaaaatacatataaataactttctgtgtaatatattaagttagatttttgttatattttccaaaccaggaaagacactgttcaaaagaatttggcaaatcacaaacactaacctggattatactttttaattgcaaatttttaggcactgtattagttaaatctacattcaatctacattgaacagaaaattttaccctatcccaaatgactagatcaaatgtatgaaaagatatatttaatgtgaatatagaaataagattttcaacccaaaaggttgataaaataaagtgtttttattttcagtcaggaaaaaaagtcatattaaaggtcactatttttcaaatgactgcaatgctggtattaagccaaagaaatttaaactgagtgttatctgctgggtgggctatctctgttctgtctcaatcagatgctttattcctattacatgttccctgtactacacctgactagcacccccctaacaaattagtcgatatcatgataagaatagtcagatcagttttaataattgcaataattttcagggttcaagagtgtcatacacactcacatatataagtatagattactatatgtgaaaattgttagacagaaagagtaacagtccaaacaccatacacactcatgtgcacacacacaaacatacacgagaaattcaactctgtaagctgcctaaaataatgccacagaaaaagtgcaggtaaaaatgttatgcatttcaactgagataatactgaaaggtgggagaaaggtctgttatactaagtaaaaacttttaagaaatgctacctcaaggcagggggcctagagaaccaagatcagtagtgatccttacacaagaaggaaaggactcctgtagaccagggcttctctggatgattatttattggggggcagaggtgtcctctgcatattaggacatttagcagcacccctggaatagaccctacccatgagatgcttagagcatcctcccagctatagcaaccaaaaatatctccagacattagcaaatgttcccaggggagtagggaggttctaagcctctgttacaggccctggttaagaacctctgccttagacccatggccaccctagttgtgatcccaatccctgggacaccaggctagttcctggcttcagatgcaaagtgagtttgcctacaccaaggaggtcagacctatgtgaacagctcactgcaaagtggagcagcttcccagaccgtttccactctggacttggcaaggaatgagggatctcccaactcaagagttcaccttcgtctagtccaggaaagctgcttacatgtctcaaatcatcttttgaggtctcagtcctttaagccaacaaccaaaggaaagggaaactaccaacagagcaaacacgtcaatcctttaaaaatgaagcagtaaaacaatcttagaatggtacataaagagcttctgggggaagaaaaattaaacagatattgaaagccaccacaatctttcttttttctacatataacttatcatatttttaaatacagacctggtgttatattttattcatgtaattcgttccctacttttttaaaattacattatttagtggctgcatctctgctggttttgtcctaaaaagaggggttcttatatatcaacctcaggtatgttgctcaaattgtagtttagctaatctgtaaaagttaatgatcccacttgtctcatgagggaagcaggatcataaactaggaaaaacaccagaatagtgtggtggttaagaatagctccatccctttcctgccacgtcactctgaacgagttcttctctaaaccatagtctctcattttaaaaaccaagattatgatagtgcctataagccattaggtctgttacaagaacgcataacctaaggatgcaaatcatttagtgcagtgtctggtatacagtaagggttcaagaaatagtatataatataatcattttattataaaaataattatttgcatggaaatgcaaataattggaaatgaccacatataaccagaaatttcattgtatcactctcataaaatatcaccttcctaacaatccaataaattagaagtgagaactagagaaggaagcattctctttgcagaataagatgatattctctgtaaataccacatttctttttattaaaaaggaaaatgaaggaagagtggcgaaacacccttactcaaaccttcatccctttttaccttcctagggtaatagaaccaaggctggagatgttaggtgtgggtacagcaacagccatttcctcttctgtgttttattattcgtggtatggttccatcttgcagcctacacagaacataccgtgctgggaacaagagtgggcttgacattttgctggggcaaatgactctcctcagagctaacaatattcttgggtgagaagtagatctcaaagcaatttctcctctcccaagttctcattcattgagaatttgctgagctcatttattcactcaatgcacattgatcaaggagcatcacatgccaagaattttgcgagaagctggaggtatcttgatgattatggttggggcactcaagccctgagaggaaagccaacattcaccaaagggatgcataattccaaactgaaccaagaaatagttctctaagagtgtaaaacctcccccagactgcagtgtcagcaaagacttccctgagtgacataaaaacagagcagaaagctcaagtgtaaagcttggagtcacatatcccagactcttataaaggcagggtctgattagatcctgccaatgagagtcagttgtgtgaagtttggagctctgtcccaggactttgactcttgactgacagtgcaatgtgagggcagaggaaagagggtgagggagagcagccgtcaacagaaaagacagctgaccagacactcctggttatgaaatcaaagtggtgtttgccttctcttggtctcttagggctgccctggttcttgatcatccccaatctggttctacagaccagatattgggaccccagatattcttacaaaaaattcccttttgcttaaggtagccagaagtggcttctgctgtttgcatccatcaagtgatttccttctggtaacgtgccatatgttgttctccactgcacttatatttaggattatgcatgtctgtctccacaactagactgtcagtttcttgaggactggagattgtctcatttctccctgaacctccaggacctacagtggtgactgactgacacataggaaacactcagtaaatgtgaaatgaatatgatgttgcacatgttcaaaaaattaggaggtttgccaataataagtataaaagctcaactagatgtttaaacactgagaaagagctcaagtgagtcaaaaagtcctccacactttacttcaattttacactaacagggaaatctctatgttctgtatctatcttctcaggtattactataaaaaaatttttttttccagaagaaactcagtaatcccacagtgtccttacccctgaggttatcatcattcagaattttcaccaccatacttccaaataggtaaaatcaacctgctgaagtggaaaggtccatatacaccactcccaggagccaactccattcacccctctctaccttttccaacccacagggcaatccacaaagttcagtaggcagccagtggacttggcttccagagagatcgccatctgtttttctacctttaataaataaagtacctctgctctataaattcacattgtttatgggactaaggcctagaaagaaaatggagatagaatttttgtccaattttaatgggtttaaaaaaattcgtgggtagcaagtttatgctgtaagaatctatgtgttacataacagtctgaatttgatcgggttcaaataatgctaccatgtcctaaaatcctgggcattatacactttccaaatgtacaatgtcatcaggttttatgacatttcctacaaaaactcaatagtcaggtagcacttcatcagttacagtttaaattcaggtatgggaacagaaaactatggctgcagcatggaaaccataccgctcttctgatttcaatgtcacagccccacgggaacatttcactaaacacttttcatacatgtgcatttttgtcccctgctaagagaactccatgtcttggaattacagagtacagccaaaagtatgttagtagggccaaaaatccactctagatgatctctgtcttcccacaaaagcttcatcagagatgctcctccacctggggttttctgtttattcagcctcacttccttcttcaagtgatgaaatgcttagagcatcatgtccatgcctgtctacatggcttatggagcacacaagacttctgagactcagagctctgaaggcaaagctgacagatatgaaatgcaagcctagctttgccagggtaaacgtggccaggaaaggagcatacctagttctactggcatcaaaacagggttgcgaaagagtctatgagaaagaaatattaagtaatactgcatgtctgacattgacatgagcttattattcttccatgccaacacaccctaatccaaagcttatgctattccaatccaagcctgccctaaaacagccaattatgctgaatgcagtctaagctccaaggagtctccagacttaaagacaatgtttcattggcccattcgtttttgtattatttctacattttgagtcagcttctaaatcatatgcatcacttctctagggattatttccctttcacattgcaggtataatagagctcctgtggctttgctacattgccagtggttttatttccttcccaaatgtattggtaaacttggtttaaaaacctgaagctgagcaacctctccaaataaacatgaaacatttccaaacccattatctacatgacttcaacaagtgatatcataatcatgttgccgaaaggagccataatatacaactggttttgttctagaacttccaaactggttcccaaacttttgagtctggctgtggagggaagtttaaaattctgcaaaacatttgcattggcaaaagtggtcatttgtcacttatgcattggaagtgccatcccaaaatattcactgagaaaactgttgtcatttattcctcaagaatgagcgcacttagtctcaacttctgacaaaatgaacaagtgtgatatttttccctaattcactctcacacctggtgtcatcatcctaaaaagtgaaattaaaaaaaggcttattctcttaatttacattaattattttattatatattcctaaagacaaaaaacacttttatctaggctatgtgatcttgggcaagcttaccataagcctcaatattccacaattccttagattaataattgtgcccatctcactaggtagtggtcaaaagtaagtaaacagtgcatgtaacaagcactatttacatgagtaaacagagtagtcagcatacagtgttccatataagcaagttcaataaatgtaagcttttgttattatttgcagccggagattttaaatgaaaaatcttcttctgaatccttagaacatgctccaagacaggctactataaccatctctctgttattcccacgtatcctagacagcccctttgattcaagggtccttagtaatctctcctgagctctcttctaaatttctgtgtcaattagctagtgctacaagaggaagaggatccaatgaccaggaccttgtccatgaagagctctacagaaatgaattaataatatgattcatcaaatcaccaatatcctgagagtttctaacgaatgcagtgtctctacttttaactctttggtaaagcctctataatttggtttgaatctaactttgtttttaaaatgtgacagactctattctgtacatgaatgtaccatttaggctctggctgaccataacagaacaggaagagactcactggctctcagagtttaagaaagattacagaactcacttatgaaaagacaaaatcatggggaatatcctaatagatattagaatgcattgataatctaatcacagcctctgcaccgaaacaaatgaatgccagctactgttgtcatctttgcatagctcggtccttgaatcaaattcacaagaacaagtgctcctggcagtagggggtgagcatgtaacataaccttggccaatcaaatgctcctacccaagactttaactctggagcaagttcatttatccattcattcaacaaatatttattaagcatttagtatcttttgggtactaaacatacgggggaaaagtctgcctttttggaatttacattctagtaatatgaatgaacaatatatatatttaaatatatatttatttatattatataaattttaaaaatacatatacacacaaaaacacatttgtcaaatggttaaaagttctaattaaaaaaataaaactggatgagagaagacagagggcaggaatgtgggtggtcatgcaattttatgcaggatggacaaaaaaggcctgtaacaaagcactatttgaacagagacctgaaagaagcaaaggcatgagccatgtggctatttcgagcagttctgtcaataggaacataatgtgagtcacacaggtaattttaagctttctagtaattacattaaaaaaagtaaaaagaaacaagtgaaattcattttcatttacctgatatgtccaaaatattttcatttcaccatataatcaaactaaaaattgattcacgaaagcgcttccatttttttcataataagtcttccagatctgatgtgcacttcacacttaaagcacacctcagtcaaggccttaatcgctacaagtggctcgtgactaccacaatgggcagcacgggttcagaatgagaatgtccccataaaagctacagtaaatgtcaggtaccaagacagcatgcctcatgtgtctgcagaagaacacaaaggccacagtgactgatgtagtctgagcaaaggggaaggcagtgagacaggaggccagactggccagagggagcccaatcctgcagggtgtcctgggccttccactgttactctgagtgacaatggaagccaatggaggtggggacagctccatggacctctgacctgtgcagctgcacaggtccctatgcttggtttaaggctctacggttaccatcctgaaattctcaattttgggacaggggtgtcatgtttacattatgcaatggacccccaaaattatgtaattggttgtgactggagagtttttatcagagagtgacatgaaccgttttatgcattatgaggattaatccagtttctgtgttaagaataggctgtaggaaacatgacaagaaaaacatctggaatgctgtagatcaacgccaggtgagaaatgatgatagcaggtgacaccaagaacaggggacagttagttccatttgctgcagcagagcacctgacaacatgcctgtggatggcagcatccaggtcagaggctcctgcggcccaccattgatttccacctaatttcctctctggccccctgttcatctgtgagccttgtatcttcccaacacattttattttttttgtaaaagagcagccattggtttctcttcacacccacccttttactaagagaaggcaggatactcaatggccccactaaaactatatacagtagcaaacagaaattctccaaaagaaaatcgggaatgctatcacaaaatcagggtcccctataagggagaaatcgagctgctaaaggaaggaaggaagagccctaacaaggtcaagcatcttctgtgttgcatcactgtggctgggaattattatacattctttccattgatttcaattaagtaatgggtataaaacattacccctgcctcccaaaaatctatatgggcttcacagaataggatctactacagtttatgtgactatcaaatgtatctaaaatacattcaggacccacaaatacattgctaactctcaggaagaaaaaattaacttttgggacctttggttattttagatttgtatctaaatttgtacaattctctctatgtttaagctgctgaataaaaaattatcatcactatttagtttctaggtaatcaaatagaaaattcatcaagcaacgctaatattgacatgatgcaactaccagtaagtgaaacaccagtatgaaaatcagcctattcttcctaaagattcgtaaaagatcacttattttccatgtgctcaaaatttttctaaaatgacaaaacatggatgataccccacttgaaggtcttatgtcagctactcacctttttctgaagaacattgatttttctttccttcacttctaacatatctttcatgtcacgaatttcaccggccagtgtccccttctcttctgtgaggtcctgtagctgttttgtttttttattgaggaaagattctttttcttccagtcgtaatctcagcgcatctacctgaaatcaggaaaaagacagaaggttgtggttttacagaaaggtcatcaataaccatcaattgtgccctttgaggaggcagggcagcagcatgtttactgagcaaggcacaatggaaccactgctcatggcacctcactgccctgcattttaacagcctacatccttcttaaagccctattgtgtgcacatctcaatagtgatactttaaaaaaaaaataagacttctttgaaataagacattatgaaatagtagtaggtttccatgtttgtttccctactacaacatgtttgtctaagcttggaaacaaagcacatcaatactcccatgtctctctgagagtccagggaggataaaatactgctcaagctttgcagcatcgtcctgaaatacggagaacacaatgagccatgccatggacatccagaggaacaagattgacatgtagagaaacactcctaaattagaaaaatacatgttgccaagaggacactcatgctgctggaggaagaaaataagatagaaatgaaacacccatgctccagcctcatgagactgctttccaaatacttttaaagaaaaaaaaagaaaaagacaaagcatacaaaaaaaaattcctccttgtaactcagctctaaaatttaaaaaaaatataattcctgctttcaaatgttgttaataaaaaagaaaatataagttttttttttaatttaacattctgaagcccatgtgcaaagaaaggtctatttctagactactcagattagatcatagaaaaatatcactggggtggtaaaaaagaaatgagacaacaaaaagaatatgaagaccatcagaataccattttgagttaattttctgtagcatttttaaattgtacttttttgatatacaacaccatatttgcaaccatgtttataaatgtacactaatccagtcttaaaatgcaactgtgacaaacactttatttgaaggattattgtccttaattatcgacaatgacagactatgagatttccaagagtcttgttctcagctaaacaatgacattcaataagttactcccaaagcatttactttttttattggatatatatattaaaaagattaggaccctttgccacaattatcttgctgccacttcagcagatactactgttatggtctgaatgtgttgctcaaaattcataaattgaaatcaaatccccaatacaataatattaaaaggtggggcctttaggaggtgattaggtcatgagggcaaagtgcctcatgaatgggactaattgctacataaaagaagcccaaaggaattcattcaccccttccaccatgtgagaacacagcacgatggcaccatatatgaagcattgattgatctctcatcagacaagaaatctgctgatgccttgatcttggactttccagcctctgtaactgtaagacataaatttctgttgtttataagccacccagtctcggtgctttgttctagcagcctgaatgaactaagacaaccaccatgatttattttttctggatcattaaagacaccttaacacttgattgtatgtcaaagccagggttagaacaatccaggaactaactcttcaaggatcagtcctgatccctttggcaaaggatgtatgaagtaactctttgtcagtccccttgatgtgggaaaggaatatgttatgtttactacaacaaatcaaaattaaataagatcatatggaacaggggtccccaacccttggaccagttccggtccagggcctgttaggaaccaggccacccagcaggaggtgagtgtcggtcaagcattaccacttgagctccacctcctgccagatcagcagtgacactagattttcatagaatctaatgaacctagatccctcacatgtgcagttcacaatggggttcactctcctatgacagtctaatgcctgatgatctgaggtggaacaatttcattcctaaaccatcccccacaccccacacctcttcgtctgtggaaaaactgtcttccacaaaactggtcgctggtgccaaaaaggttggggactgctgatatagaaagtgtaaaagacatgtccacaaaatgattttcatagagatgcccacagcaacattgttcataatggatcacacaggaaacaacacaaatgtctatcagtaaatgaatggataaataaaatggtggtgtttttatatggaatattatctatccataaaaaggagtgacctgcagatatacataataacataggtgaatctcaaaagcaccccgagtgaaagaatctagaggatttatggcatgactgtgtttccatttctgtgaaattctaaaagaggtgaaaataatctatgaggttacagaaatgagagcaacagttgcctggggtggaagctgggaagggctgattataaagggacaggagggtgtttttctgttctctaaattgattagggagagtggagaacagttacctggtgtacaaaattgtcaaaactcattgaactgtacattttaataatttatactttgatataattataatttatatttcaataaatttgaaaaatatatgaatacataactaagaattaacaaatatcttacaacaatgtctttcatgaaagagagaggtcaaaacaaaacaaaacaccaacctgggaactaaattaccttataacacaactgggagaatgaagtgggggttggataaggttcccatgggtgatgaggtattgaggtgatgaggtattggggtgatggaaggacttaatcttcaccctccatagcaggaagtcaacagatagtagctataccagcaatcaggaagtagagaagcaagtaggttatttagagatatcaaaataaccgaacaagaagagttaaaagggtttgtcttagggaaaaaaaaaatggaacaggggaagtaaaggattgctgcatctcataacaaaaattttcaaacattttgcttccttatcctataggcaagtaaaatttgaatggaaagaaaaaaaaagaataaagaaatcaaaaacaaaaatgatacaagaatgccataagaaaccaatagaagatatacaaatacccaaaaaacatatgaaaaatgctcaacatcactaatcatcagggaaatgcaaatcaaaactacagtgagaataccaccttatcccaaccagaatagctattcttaaaaagtcaaaaaacaatagatgttggcttggatgtggtggaaaggaaatgcttatacactgctggtgggaatgtaaattagtaaaacctctacggaaaacaacatggagatttctcaaataactaaaagtcaatctactattccatcccactactgggtatctacccaaaaggaaagaagtcattgcatcaaaaagatacctgtatgtgtatgtttatcacagcacaattcacatttgcaaatatatggaatcaacctatgtgcctgtcaaagaataagtagataagagtagataaagtatgataacaaataagatatatatatgataagaatgaaataatgtcttctgcagcaacctggatggaacttcacttaggccatcattctaagtgaagtaactcaggaatggaaaaccaaatactgcatgttctcacttctaagtgggaactaagttctggatacacagatgcatgtgaagtcgtataatggacattggagacttagaagcaggaagggtgtgaggaggatgaggaataaaaaactacctactgggtgcaaggtacactactcaggtgatgcgtacactgaaatcccagacttcaccactatacgatttactcatgtaaccaaaaactacctatacccctaaagatactgaaatttaaaaattaaaaaaaaaaaaaaagaaaagttcagggcagcagagggtggcatttaaaagaaaaaaaaagtcaataggaacaatagaaagaggacacttaggtttttaggactggttctgcttttaactgcctgagaggatcaggacagataactctcatttcccctccccagcctttcagcctcagtttctccatctataaaaccaagaggtgtgaacagatcatatctgacatcttaggatttttaaaggcaggaatccgtttttggtagaatgcgtcagggaaggatgatgatattagcgataaagaaaaattattggagtagaatatccttttcttgctccttgccaagaaaggggtacctaagttgtgtttctaaaggtcaaaggtgacagggaagttgggggagtagagagtttttccagtttctgctccagtgagaaggatgaagctgggaggtccccgtaggggaagggttggtcacagatgtgtggagcccccaagccctaatggccctgactgcattacaagagagagtggacattctgtgactggggaggagaacggcagattcttcaaatagctgatagctgtgccccttctcacataatagccagaaagatacagggcctggaaaggtggagggatactcacgtcctggggatcttcctcttcctaaatgaaaattcatgacaggtgcactaaagatgatgccctacagatgggccacagattctcatgtggcccatttttgtttaaagttaccttcatctaccagcctggcataaaaccactcttctctgtaggttttcattatatctggtgaaaaaatatgatttttgagtttatgcacaaatataggtatttggtggattactggaatattggcagaacatgctgaacactctggattatagcagtggttataaaggggttacaatcaattgtagatatttgcacatgggcttactaggactcagtgtgattctgagaagaaacacatgactgaggtcccatttgccctgcatcctacctatcaaagctggatggtctatatctggactaaaggaaatgcctaatatccaaactgtgatataaataaattacaatatgggaggtagtgagtggtgctggagagagtttagaaaaagacactctgtaatcatgagagagagagtcaagggctcttaaaattatttggtgttgagtgaagaggcagagaaaaatattccatatacccaaacattttaacttttatgtctctacctgatgttggaatgtaatctagactttaaggcttaacatttatagcaccttctcgccatgtgtgatctatcagtgccctgtcgcatcttcccaagcccagaagagataaaaaacaaccctagccatgagaatatttctccagaaacaaaatggagagcgaggatggttgtgatcagcacgttactcaaacacccaaattcaacatggcaggagggagcctgtgccagctgaggtcttctgtttggggggtttattttccatgcactggaaagtgtgtacttaacttcaaaggaatttgggtcgtgcctttcaatcaccttcactctgtctttaaagttttgcactagaaatgggcttcagggtcttctttttttttttttttaagatgaaactttgacatgaaccacaggcaattcacaagcaacattagcccagtgtgcagtaagcaagtatgacatcatctctaaaaccaaatatgaacttccacatggtgcaaaaccacaagcaggcacacaagcctttggatgcaccaaagtttaaatacagggaagataaggcaagaaaaaatgcattctattaaaaattagaatatctagttccaaattaggtatcaatgactgaaattaaagttcccctcactaatattctgactccactcaacagagtacatcacttaaaacagaatcagaaaagcctgaagtctagattatactccaacatcaggtagagacataaagttaaaatgtttaggtatatggaatacctttctctgcctcttcactcaacaccaaataattttaagggcccttgactctctctcttaaactttggcagttgactcaataataaaacttggcaaagcaaagagcaccatcatttcccagaaaaacaaaagaaaattagaactgtatgatatagtccatgcacaaagacccagaaggttgaatttccaatttttacatatgacttaaccacatgggaactagtcatctaatgttaaaactaggacaatctttccattttaggagaattgctcatttccttttgatccatttgtgtgtgtgtgtgtgtgtgtgtgtgtgtgtgtgtgtgtaagagcatgtgacatatgaaaatttaaccttttatctggcagtataaaacataaaacatttgttttcacttcagttccaggtaataacttgaaagaaaagaaccatggcaatgaaattggcaaaacgttgccaaaatcagagttaagcattattaatcttcatgtcagcacccaggaattataaccagttccaatggtgaggtatgtttccagaagttctatacataagacactcgacctttctgccgtattttatgtgcgccttcagaaacggtttcaatgttgtgacaaaacactaagtgctacttgatgtgccataaataatttctaaaaatcaaacagttcatttcaatcttaaaatgactactgcaacacttgagagaaaaaaacacctgagggagaaaaaggggccacttgaaaattttcacagattaaatactacttgcttgacaacgcttcaagaattgaataaacaggctatcacaaagaaaaactttaaaagaaaatgaaactggaacactcacaaaagctcccaatatagttttatttcacattcaaagcttcatttgtttgtttttcctaatcgtagacttgagttaagggtatatttgaatttgattcaacctgcaatcattcaaacaggagacagtttcaaagttggaagtacgcataatgtacacagtctccaaagacacaaacactaaaaataacctaaaatctaaaacttgcttggtagtaacgactagttctcactcacatccaactctcctttcctcctgaaaacaggaaagatcacacttctcaggcgccttttgggaagatgaaacgctgtgttttcttcaggaaatgtaagcagaagtgaggtacatcacttcctgtctgttccataccacactccttttcttcctcagagatcgtagaggctacactttccagatggtggagatacaagatggcagaaccttcctaagtctggatcctcaagtgactgtgagaaacaggttctcccccaagtcctcaatccttaaaacgggttggacttacagtatgatgggttaaatagcttagaaattattacaataaactcgtatgattttgctgcaaaataggcaccttaaaactaaaactgttttttttgtcttagagattgtcatgaatctaaagaattagggctatggtacttcctttcactctttctatatataggaccttcaacttcccttctcctttcatcccaaatccaaagaagggggaaaaaatgacagagggccaaagacagagctaagaggaagaagcagtagaaccttgggggagtagacacgggggttaaagatcaaagccttgggaaaaagagagaaagacagactgaagaggaaagatccccttaagctcatcaacttgagtttcagtttggatagacaagcggctcaggtgggtatgttttgcaacatcctctgcaatgcaaatatatatgttcaactaactcataacaatggcctttcaaatgtcatgaacatttctaaggtattacaaggaaaatggagataataacagtacgtccttcattgagttattttgagtattaaattaaataacacatgtaaagcacttagcatggtacctggcacttagaaaccctcaataaatttttgctattgttattatactttattattctacttttcacagcctctaattcagtgatttatataccgcaggaatgcaataaaggttgctgatcaacagcagccctcaggaagagtggagaaccagcaaataaggttttgtgctctaacatgtactgaggcgttatattgtttgacatttacttaaaaatatttcagcatacactctatggtatgtgtgcagtgtggagggttgtgtgggtgggtggacagatgggtgtattacccaactgggaataagtcctccagagttagttaattagctatgaaagactttaattaaaagctaacattccagagtcagctaccaaaaatacctcagtattctttatatttgatggacaactgaaaattgtcaattaacataatttatgtgaggagtgatttctccctggtgaagtgaatggtatttgagatctgtgcagtggctagaaatgttgcacaggcatgtccagtcttccaagagcaaggtttaagactgtgtgtccaaaataattagatgcaagccacatttgtacttttacattttttaatagccccatttaaaaagtaaaaagaaacattgaaattaattttaataaaatatttaatctattatatctaaaatattattactcaacctgtaatcaatatgaaaaatattgagatactctacattttttgtattgtcttcaaaatctagcttttttttaatacttttagcacatctcaatgaggattagccatatttcaggtgctcaatagccatatgtggctcatggctaccatattggacagtgaaggtctatgactcctgtaagcccaaaagcttcaacccttggaatggaatcctacctaggcttagaatttcaatctcccttgcatattgatgattcagggaggattctggcccaacagcaaacagacggttggctgagccctgtcacaagacatagcatcacactgacttagagagaagctttcatggacatgaagcttccagaaaaacagagagctgaaacttcaaggagtgctcagggaagttgtacagctgtgatgtactacatagaggccaggtggtggggcaggagtactgccttcttcccttctctaaccatcaggggctactgacctctacaaaagaaaatttttgacgaataatcatcaatgaccttgatggctggtaattcagctagcatgaatctttctggattcttgatgaaataagaactcagaataatcactgctttcaaaaactctttcacgtcaatctctaattatagcaaaagttgcctttcagaaaaaaatgtccttcagcagctgcatcatcaaaaactggctctacggatgagggtgtgcccatctcttaccctatgcttggttacatcctcctgctctttaacttctgcagctattttaatttcagatttctctcctgtctgtagttaacctttttataagcagtaaccagaatcacttcttcattcattcaataaatatgaagaatcaattttgtgccaggcaacattctagtgttagggatatagccttttaacaagacagtcaggtttgtgatttattgaaacatacggttgtaaggttggaggtagtggaggtagaacaaataagtattatgtcaatatcatttaataaatacaagttttagcataagagtggagtaaaacagatataaactctaagaacttaaatacttaaataaaagccttgtaatactaaattcaaattggaaatattatgaatacatgatatattttcatattttcttttttttttttttagatctgggtttgttacgtaatggtgaggtttgggtcttctagagtacgcatcacccaaatagtgaacattgtgcccgataggtgatttttcaatgctccctggctccccctacccttcctcttttttttatttctagctttgtccactgtagacctagaaaaaaaactgaccacctaagtagcgatgagaacccaccccaggtgcccaaattgtgatctctaaaccatttttcactaaaacaaatctactttcattgtagaaatgattgattttaggtctaaggcaggatgtgcaggtgagttcagaatgccttgttgaaccagaaagcaaggaagttattaaagaccaatagagtcttgctattggtcaaggatgggacaatttgatgcactttttctttaaaattcgctctgggtgttctatggaaaacaggcactaggggacaggaatggaggccggggacaggtgaggagctgctgcaatgagccagaagggagaaagtggctgtcacaactaggatggaggtggtggagagggggcacgtggctgtgtttgtgatgcattttgagatacagaagacagctggcagaactgaggatttgtatgtgtagggatgaaaggaaggaagatatcaaagaagactcctgggttgctagctggaaaaactcagtagatagtggaattattgcctgtgatgtggaagactggggagaactggacttgaggaaaggaaatcaagagtttaggattaggcatatatagtttgagatggctaggaaacatatgaaaagcaaatggctatatgatttggaagctcccaacacaacagaagctggactggagtctgatctacatgtggatgggcagtcctgtaattacatcaacatttcccctaatgaccaggtaggacaccttctgcacatttacagattcactcctgtttcgatgcagctctctgagaccaaattaacaaaaatgtgtaaggagaggacatcgacattgttgaaaactgagagaaatccccttcctaaaagggcccctgcttttaggtcttttgctataaggtctcttcctctcatagtcatggataacaagagatttggtcatctcaattgagcctttggcctttcaaggcgtctagttaatgtcaatgatgtatttatcctcctgttgatgtctacagtcagtagagtaatactgaatcagagataaaggactatataatcccacttctgtgtgctgacttcatttagcagtcaaaaatttacacacttgacaagagaaaaaaaacctatattatatttaaaaacatttagatagcacaaagaaaaacaataatgattgtataataaagtgcttcataatttacagtacatgtttctcttaggttgtctgttctcatacaatttgaattcaaaaaatagaattcagggatatttagtatcatataaccacatatatcatttaagctgtgcttataaaagttaagttacaatcaccaacttgttaataacacagtcgagattttcaggttgtaaaaatgtgtttgtcatgcctacctgtcaaaaaattatacccaagtcccacatgccacctacttgaagaaaacaatgctgggttgagagtgctttgtatcacctacatgggagaattcatatcacatgtgagttaataattcagccaactttataaacctgttttcatacttaagtttttggctacttcttacactaaaattaggtggttttaagtgactagtccaaagttcaaaatttaatgctcagttcagttccagcaaatttctgaaaacacatgggaattgtaactcatgtgttaatacttaaagttttcgttaataaaacttccaacactaaccttacctcattgaacttacctcactgatttttatgctcactataaaactatagctgtcataatatttttgaattactacaaaaggaagtaagccattccaaagtcaatgttattttgcaacatgatgatagttataaattcaaaatacttaaaaccaatttgcaaagctatcaatcttagtacctcctaacatttataaagcccatcttcaaaacatttgctattacggaaaaaaacaagtttaagaaaataccatgtgtcattcatattgtgctttcccttcaggtaagcacattaaatgtaagcacgaaattgtgttttaacataaaattttaaaatattgatcccgcttagatatgccatgaattttctaaactatcactgaagctccagaacttaaatcacagataatttagtactaagtaataattttgtgatctttaggtcagtgctttttaacaaatccaaacaaataacctccaatgagatatgcctaaagtatttgtaaatgactaacaaattaggcactgtatttgttagggttaaacccatgttttagagtcgtgtctctcaaatactcctggaggatggggacttgtgtttaaggatccagaagtttgctataagagcgttcttatgttgtctgttcttttctatgtcatcttttcttttctatgattatctcaaaagttaaaatgaatttatcctggatcatgtaaataactcttataaatctggatcaggtaaatctctccttgctaatagatttcaatatagcctttgtgtttgcacttaagattgctttggagtgaaatggaaaaaagcacagaacttcttgtttctatgatacattccctccaagtctcaaccacaggacatcatgctaaccatgaaaaccaggggttcatcagcactataaataaaaacagcaatcagcgaggaaactggatcttcacacaacataccactagttcaggcctcctgaactagcacctcagccataccagtttgtaccacattcatatcagtgtaaattcatgcgtggaaaacactatccttctccatattaaattaatatcattaatttagattttattaactttgacattgtattttcatttagtacataatcttgatttggctgcatagttctataagagctataaacatgcttaatcttatgtttgtcactaattaagtaaagtagtaattattacataaaacaatactaggtgtctacaaggttgtttatttgaaaaaaagaagaagaaatgttttctcaactgtgaaaaatactactctaaaataaacagtatttgttctttgaaacttttctgagtgttgtgcaaaagttaagtaggggtgtggaagcagggtgtgtgccatgatggagcagacttgggaaacattgtgggctctagtggtttatggtagacagtagcatactaaaggttctgaaaagtcccacagcaaagatcttctttaaattgatttaacttacctttccccacatctattttttcccaccgaacccgttcttttctaagaacacataataatatccttcagaatatttttaggaaaggctgttctaaagtatctttaagccatcaaatttgtaaggtgtggcatgggtaagaaaggtttgagtgtggcaaaatgggaacacactgctgaaagggactcagaaggccttggctgacagtctgctgatacttttgagatgccctctgtggctaacactgcattaggtggtgcaggaggctcctgcattccccagggcaacctgtgatgtaagtactgcttaaaggtgaaaacagtggagctttcagggctcagagacctagtgtagtagagctatggcttaaagccccatcttctggtccaaaacataccccagcagcccataccctaggttcatttctggctctgctaggacctggggatgggaccttgggggaagctgcttatttctgagggactcagttatcttttgataaaaaaataaaattgagataaaattttgctcaatgacttctaaggactttacctaacctaaatttcatgtcaggaggtgaatgatccagctgtactgtattgaaacatatttaaagctttggtaattaaaacagtttggtagtgatgcaggaagaaaaagacagatcagtccatgaacaataatgagggagtccaaaatagactgacatacacatataaagttagtatatgataaaggtggtagttagattcagtaggggaaacatggattattccattgataatgactgaaaacttactttcatttagaaaaataataacagtgaaactttacctaactctttatgacaaaaataaattcctaataaagagttagatgtaaaaaattaaatcataaaagtgctaaaacagatggggttgggggcagtggctaacgcctataatcccagcactttgggaggccaaggtgggaagactgcttgaggccagaagtttgaggcaagcctgagcaacgtagcaagacctcatttatactaaataaaataaaaaattgtttgggcatggtggtgcagccctatagtcccaactacttgggaggctgaggcaggaggctgcagtgagctatgattgcaccactgctctccagcctatgcaacagagtaggacatgggctcaaaaacaaaaagtattaatatagatatatgaaaaaattttaaaaagaaaatatgggggcccttctttttattcatagggtataggagccctttctaagcaagagaaaaagcctagacaccataaagtaaaagacagataaataagattaaatttaaattgaaactatcttcatggaaaaagacaaacggcaaattgcagaaaatttttgtaaaggcaaaatgtaaaatgcagcgtgtattccagtatgtctaacatgtttccaattgggaaaaaagaaagaacatttgcttgtgtgcacacaggctatttctggaaagatgcataagcaaatgaaaagagtttattaaatgcctccttcatgctcagttaaatgagtgataaaaacaaggattaaatgaacacatttgtcaatttcacttgtaaactaaccaaggaatcccacccaaagattcctatgaggaactaactcagtgtaagagaaatctagttaggcccagagctcccagaaaattaattgattgcctgcatttctagtttagccctttcttgaggacagaaatgctgcaggtggaggaaatggccaggacacactctgcccaggaagaattatccatggtggtacatattatagctgttatgactctttatctagcatattaatacattgtaggaaggcaggaaaagagtaatggctgcaagtcggagctcttgactcctcaaggtcaaatcttaaccttccacttactcaccatggcttagggaaagaaagatacaatctctcaaaactccagtctcctcatccataaaatgagggtaataatagtacagatactatgaggattaattgaaatatgacttttaagatgttttattataaggcactaagagataaagtagagacaatcactgaacagcagctgctgtttaatagtgaaaagtgacataatttatgattaccatgatacattatatattctatcatctacatatgattagtaaatttagtcattagagtatttatgttaatattctagcagttatcattaaaagctaatctcactgacaataatgataacattagctaatgcctaggaggcattttcatgaggcccctcagcatttttgagacagggtgagttcttgttctccattttagaaggcccagagccacatggcttttaagcagcaaagccaagacatcacgctcagaaggaggaaagcaggaaatatctgaacagcataaatagcaaccaaagcagtggagagaatgtggtatgaagcaaaaaaagggtgaatgtactaaaattatgacatgtatcttatcctttctgacatatatagatagatatttatatacaaggtaggtattatttagaagtaaaaacttcgaatctctgagacgtctcctagttataatgatagaagtgtcacttatacatgtaaggcgtttattatgtacatttatatattattacacttacatgtgtgtgtgttgtgtgctattctgcatccagtctaaagtgctccaaacaaaatgtcatcaaatggaaaatccttcaaaatgccaagtgtaaataacaccttccctctatgtattcttatgttgtaatgtttcaacttcagccaaatatttaatactgaaatagttttaacaaatttgctcttcaaaagaatgaaaacatgtatcctatcctcagacattcagaaacatcttttatgcccacaaatgctgaaggaaagaaaggttcactactgaggttccattgtaacacctcccactaaggtgtgtgttgaatttaggaacatactttcacatttaagccaagttgggacttcacatcattgagttttaggaagagcataaatgattctgaaatgggcggtaacaccaaactctgtgcaaatttaccttggccagagcaagtgattgtttctctgttgggacttgttacagcctcttccaacttggaagcattttcatactaaggaacacggagctggaaaaagaactgagctccatgagtaaagaagacaatcactataaaaactaagctggaagcaagaattgccatgatgttaaaaaaattagagtcaacctacatatacttattgctcacttttttttttcttaaaggcagagcaacaatcatccctttgctagtatacatcatggctcctgaaaaatatcacagcacttatagcagtgaacattttggtatggaaaatctgtttcatcctgcgaattttctatttctgtgtgggtttgtgtgtgggtgtgtataaatcaatttactgtgtaagcattgagtcaacaatattctattgtattactcttgaggcagtggtttctttgttcatagtcctacaattttatgagagaaatcataacttaactgctcaaagagtaacaattggtaatgggaagttcccaccgttttcacatctgtaagatgaagaggtggaactcactgatccatttgcaactctgacattctgtgatttttatgatgccattttgttagttcatattatgcaatactgggacccaataaaacacccacaaactaaggggctattgtttctgagcagcctgatatcctatcagcaaacctggtcactaggcatttacccatttaaacagtaaacatttgcagtgcattctaagagggagatacagagagtattttgcatcacatttagccttccaaacagaatatcttggattgcaaacaaaaaatcatgcccctagctttaacaattaccaattttatagggagggggaaaatgtgctgatagcatcctatctagctgaaacacaagaaatacccagaaatgagagcactcatctaaaaggaaatactgtctgagccaaagggggatgaatatgtctagaaactacaaccttctgatgatggataaaccaaatgcatcaagcagagcttgccactctacagcatttcaaatgcaagcaagtttgcgcaaagacaagtaaggatgttttcaggccaaatatattgcccgactcctttataaaccatacgaatagcagaatttgagtcttttaagaagcagtcaccatcaaccaaagtggtctcaatttctactgtagttttagaagtggagcgtgaggaaagacacttcttccctccgagattcttcttgccaggcactttagatcctgccaggaaggacataaatgaccagaaacatgaacaaccacctccacttcatccctaggcattccctatgaggcacaggttttgctgcataaaatatgttcgtgtccatttacattaagcttgaattccttggcctcttatgacatcattgagactggtcattggaaatgtttcaatgagactgactgttcatacctctcataaagtgctctgtttatcatcttagggaatctgcttgtttgtatcacaggtccactccagtctgttggaagcagcttcatagagcctaatgttaggaaggatcctaaggccacatccagacttggtgaaaagatgggcaggatgaagcagtgaggacttctagacacacaagtttggggagccatggcatgcctatattggcccccttgatctagaacacccaaccctgaatcttcacaggtacatgcatggctggctcttcgttcttggactaggcttatgtatcctccaatcttgaaaaattgatttagtacctgtaatgagttgaatggtggtccccaaatagatgtgtccatgttccagaacctgtgaatgtgatcttgtttggataaagtgtctttcaaaatgtgattaagaatctcaaaattagatcatcctggattatctgggtaagccctaaatccaaagatgagtgtccttataaaagacacacacagcagagaagagtagaaggccacgtgaggacaagagaagagactagagctatgcagcccaagtgaaggagcctcctgaagctgaaagagaccaggaggattctcccttagagcctctgtggggtgtgcagattttgcaacaccttgatttctgatttctggtttccagaactgtcagacaataaacttctgttgttttaagccaccaagtttgtggtaatttgttatggctgtcctagaaaacttatacagtatcccctttcatccatccacttaccactaccagctaatgtttattattttttatggggattcaaagaccaatgaaacaccgtccctgcatttcagaggctcttgttctacagggagtgatacgtaaaccaacaactatgggagtgaagcacagaactctcctgaaataatgttgaaagcatcctcagaggatgtaacatgactgtggtccaagagtctccatcaatagagccggaggggaagtacacgggatctccacagtgggcagacaggacaccgaggggccatgtgcgagttgccagatcctaaaactgtgtccaccatagttggtgagcttggatggcatcttttcctgtgggaaaaacagggaatctgtagaaagtgctgttcctggtgaagtaaaggatatgtgaaggtttcttttcctacctcagtcctgctcaagaactcagaggtctaaactccctttcatgaaaacacagactttctactcctgaccttgcatcttgcctttcccccttgccagacacatttgcctgaagtttccttcctccaaaactctttgctacatggaatcccagccttcccaaaagtctttccagagaaccagctctacgagcactcttattggggagaaaaaaaaaggactgaggggaggcagaagacattccaaagtaacataaatttgggaaatgctctttcaggaatttgcaaaatgctctgagaagtccagtttaactttggttaatcagcatttcccaaacctatttcactctaacattgtcttttttgtaacatcttattaatatcctggggaacatactatagaaaatgctgcatttgaataacgttatttttcaaatgtaagtttaatagattatattctatatttggtaggccctccaatatatactgctggcttaactcactgttggaacatttttccctctcctgccaaaaacccaacacctttatcaaaaagcatatccctttaccaatgccctctgatgaccactaagcaagcaagaaccaagcaccccagtccaaggcacagtggtagaccctgggaacatgacatttcccaggtggcatccttgcccttgatagcttacgtgacttcactttatacagcgtgagttaattctacactcaacaaaaccacaaaattaaaagtatgttagaataaccctgctgggaaaagatatttcattttgattgttaacaattctaagtattgtttgcacaaatgggcaaaatatcttacaaaatttgccttcctcatatggcaaatttcatcatattcataagcatccctacgaacatgaaaaaatgaattttctgaaacatctttcctcagaagatcagggatagggcatgctcccatgccattcctttctgtatattccctgtcaccactagttagttgcattaacattattaagttgcaatatattacacacagtacagtaaaagctgtaaaaataagctcttggttatttcatgactacacatgctataagagttattcagaagacggaattacaaggaaaggggcctaaaaactccctctcttacctctaacagttgtcctcaacacagaaattcaggggataatcaaattaaggaggaaaaaaaatcatcctctgtttttctcttcatactacagttctgaatggaaagttattttccaggcaaagatgaatgaaatctgctctttctaatctctgtaaagattgtgaaaataaagatccatttcattggatagagtgatgtcttctctgaaaagcagccatattctgacataatcagagatgagtgggcaggacctgcactctgcggactgcaggctggtgcgcctccagcctgcacctccgtaactcatatcacacctcaggaaaacggacatcacaagaactgtttctgtcactgaggaagataagagcatttacaagttggacaataacaacaatattataacacagaaagagagactgttttccttcaaagaggaaacatccacatacgtgcttcacctgttcctgtaacagatgaggagtttcattctaattcctctttaaaacaatgtaatagtaacacaacctactgctctttattgaatgccaggctaagggcattactgctggggaggtagggagcatcattcctccagtttttagagaagggaagtgagcctcaggaaagtaaaggacttacccatggccccacatccaccgaaaatcaaccgggcctccccagccaacagaatagcccagaaactgaaggacctgaaaaatgtaagtggcagacaaatggaatccaacaactcgggtttcctgatttctaaatccaggtccggagtagccattgtggttttagtgtccctataatatagaggaagtcatccattaaagacggaaatgtactgagtgggaaacattccagcaagaggaaattgggtcactcagagcctcagaggagaatgtcaaggggtttgtgctcagacctgctgagcagatgaaagtggcctatacacaactcagccaaagaaactttgcagcttttccctcatcctctgcaaccggtgttggtgttgggagcataaaaatggattttgattgggctacctttgagaattagactttaaatccagcaagatgtggtactttcaataacaattgttaccagatcttgtcacctggatgttcttacgctcatattttattcatacgttcactggctaacttttccctccctttgcttcacttatgacagagactaaacactggaatcgcaaatcaaatgcaaatggaggtcaggcgagtgacacaagcgctccctccagctgggtgggacggggtggactggcagccacacctcatcccatccccaggggcagccagccacaccttagctcccacccaagactgccagaggaagcccaggcagtgctagggacagagcttcacatcacccaagaaaaactagaaacctacattattacatgaaatgtcatgattttttcattcctggcaacttattttgatatctttaagaaaaaaacaaaaccaaaaacaaagaacacggggtgagaacagaaaactgaatcctggggactggattcaccccacaggtttccagcctagaaaaactctactaaacacagcagagttcagcaatgaggaatatattgagatcattccatttgaaagacagcctagagagcttgttaacagtgttctgttttcctaagaaaaggtttacttaggaatatataattagacaaagaagaaatatgcaattctgtgtcctttctattaatattatgctcttctaaactacaagctaaacaaaaagttaagttgaatttcttcttgaagaaagtgaaggacttagcctgcaaccccaatttcttcttcttgaacccactgatgttgataagtagctggtatatttttgaactttaatagaaaccttgtcaaaaaaagatgtgcattattcactaaaatgatacattaatactacttgcaaaaatgtatttgacaactttttttttgtcaccattgaccaagttccacgctctgttgctgaactctgaggaagcaaacaatggtaaatgagatagtcctatctttatcactgggttagcaggaaggacaactaaataaacatcccaataaatgttggttacctgttaaaataggggagggagagagtcctaaggggatgcaggatgaattagagagagcttcctggaggaagggatattgaagatgagacgaaagagaaaatggtcagggaaggggaaaggataatttgagatgagatgatctcaaattcagatgcaggaaatagcactatggcttagagaatctgaagtgagtttgatatgcctgcagaattcaattggcagggtgaagtggggacagtggagagatgatacagatgaactgggccatgttatggattctgggttttatcttgatggcaataggaagtggcatgatcaaatatgcccgcgagaagaagcactcagcaaggatgtaatggagccaaaagtgtcactctgtgcagagacacaaccttccctcctctctaagagggatgaattcccacttgctgagccagctcccaagctcccctttgttgtgtaagacccaaactatggactaagctagtggttctcaaccaggacaatcttgacgcccagggacatttggcagtctctgtagatatttttggtggtcacaatagggaggcaggagagtgagagtggcatctagtgggtagaatccaaggaagtctccacaacaaagaattatccagcccaaaatttcaataatcccatattgagaaaatctgaaataatttaacaaaaaaactagaagtgtatctatctatctatctatctatctatctatctatctatctatccatccaaactattttttaaaggggcaggaggagagaaggggagagattccaaaaacctacaagaccttggtgtcaagaggagtttgccaggacttagaagaggtgagaagatacagaatagctgagtgttaaagaaggaacctgagataaaaagaaggaatagttggtaggaagttcagcggcactgctagcccagtatcaatgcactgtaaacaaccagtgaatatttgtcaggtgaatgaattaatgaatgaacaaacagatacatcaatgaactggatcttctttaatgagtcaaagtaaagaactgagaccatctttgtcgctatgacttaaatgttactacagactgctatgtcaacatcttagttgtttgttccagcaaatctttgcccagaaaaaaaaaaatcattatttgctccaggaaattcccattgatagacttattggagaaaataatctgctcactttggcaaaccattgtcttatcaatcacagtttattcatcgcaactctcttcaagaccctcactttgctgtgtacaacaaccctacattatcacatcacagactttgaacaattccaattagttctgcctgaaaggcccatcttaaaccacttgaggccaaaccccaaagacctataaacatttcacctctaattttcccttcttagacactgctaagactttgttgaggtggcatgctccctcattggaataaggtataaatttagctgatgatattttggggcattcaacagaatggaattactttttaattacttcggttattgggctatgtgtctttgaatgcgacaggactaggacacattctagatcctgtattttttttttttttaagttacattttagggcctgtctgggattttgaaccaaagctaaagtacccagctgtaccatgtcttaaaatatccccaaagaatttcatccatttatttaaaaatattcctggggtacctgctgtgtcccaggcactgttctggatgttaggaatatcagtgaacaaaatagttttcagtctagtgggagaatggggcagggcagaagaaagacaacaagcgctaaacgtagtaaataattaggttatatagaacgctagaaaatgtcatagagcaagcctggggaatcctgcagttggagggagctgcagttttaaacagggagatcagtgtaagtctccactgagaaggtgacattagagggagaggacttgaaggaggcaagagagtttgcaatgtgaggagctagggggaaagcattccaggtagagggaagagccagcacagaaaaaaaaaacaaagatgggcagatgccaggcatgttggagcaacagcctggaggccacagggttggaatggagtgagtgaggagacaatggctaggagacaaggtcacaaggaaatggggtaaggacagggatgaagaagggttacacagacctgggtgtcactgtgaagactttggttgatatggtcactggagggttttttgttattattgttggtctttttttaagacaggatcttgctctgttgcccaagctagagtacatggtgtgattacagatcactgcaactccaaccaactccaactcctgggctcaagctatcctcccaccttatcctcctgagtagctaggactacaggtgtgcatcaccacacctaagttgttttgtttctatttttttaagagatggggtcttgctacattgcccaggctggtcttgaactcctggcctcaagcaatcctcccacgtcaactttccaaagtgttgggattataggtgtgagccatcatgtccagccccactggagggttcctgagcagaggaaagacagaactagacttacgttttaacaggttcactgtagagaggcagtgggagaagcagggagaagttaggaggcatctgccacaatccagataagaattgactgtgcctacacccctcagtgaggaggatgaacagtagactcattccaggaagagccaaggagatgtctgcacaggttggttgaggggtgtgctagctaaataggcatttaatataacttctagactggtagtctcatgaagaaatcagggtcaatcagacacaagctgtccttattcttaaaacacaacttgaaagtcagaaaaatgggtagaggatctaaacttggcacatgatttcagaaagaatgcacaattcaggacttatgtttctggtacagaaagaaacttgtaaggcatgatttgagttcactgaataagagaagtttttaaaattcctttatgaagatccaaactgtatactaatgttcactataatcttgataggtgtctagtttcttaataaagtaggatcccttttgcactgggggtgggtggggatccttgagaagggcctgcctgttcgctaggcagaaggttcaacaggaagaaccacagtgaagagagccaagctccgcctggcagcacctccagagatacaatagaattacactggccccatggaaaaaggaaaatagatagaagttcacctgtaagcagaatgatccagttatgtattagagctcccttcgtggaggtctgcaactgggaagaaggaaccaaaagtattaatgtttaacgaggacacaacaataagtgtgtttattcttcactgtcctgttgtcctagtgttgaagggggaggggcctttaacttggggttgtctttagggcctttctggactctggggacaaagaaaatagaggaaacataaaaatagcccagaggttaggtacatgttttgttttctggtttacttatttatttttttaaatttgtaatgctgaaaaaatggagagcaaggcagagagaaaagccactttggtcaaagactagccatgagggagtaacagcagccctggggtgttctttgaaaatgggacaagtgttgctagtgtttataaactggcttatatttatcagcattcttgtgctagcaagtcactggaaatatttccagttagtttaagaagaaaagaggatttagtgatttatgtgattccttgggataatgttctttgggatatagaagtaaagattactttttaattactttggctgctggaggtgtttcattgactgtgacctaatcaccacggtgaatcaatcagaggtgatcaggtgttaggcccagccaatcgcagcccttcttaggaccacgtaatgcattcaatacggaaacatgttttattctattggggttgcaaagatgggaggatatgaacgaggatatgatactgggtctgctgatggccctggcatcttccaatatatagcccccaaaaaggaacaaaaggccaagatattgaagggggaaatgaaagaaatgcaatgatggcaatgtttgagtctctggatccagctatgtctaaagtcaatgctatcctgaaatttccaatcacacaaatcattaaatccacttttttttttttttttgctaattttaaaagagttgcagttacttgctagcataagaatgctgactaatgtaaactgaagcccattaagcttcccattccttctttaaaatgaactataaatcctcaaactaaacacaatagtctctgactcaaccaaggggctttgggtcccagtctcagttttcccaggctgcacccttactgacctactctggtcaagccactcacccagtctctgcttcagtttcctcatctgaaaaaatgatgggctctcaaagaccctgtccacctctgatactctgctttcaccctaaaaatgtgcaggcaaccacaagagctaaagcactcggaaactattccccatcaccaaagccacccttctgattttttcattacaccaagacattttacctaaataaaatataataaaacagggaaaactaagtacctatttaaaaagccattgactgaatcttctcaatctaacaaagtaagggaaaaatgtgagacatgaccccatccaaagtagaaagcctaaatagtaactgattcctactgtaatagcaactaggtgaattttttcaaactttcaagaacaaatgttttccatataagatatactactcaacaacagaaaaaaattgttaattgatgctgtcaagaaatcttactatcctgtaaatcaacacacaatctagctatgtacatatataaaatcctccttattagtatggatacaaaagtcctaaataaaactagcatatggaatttaaaatacttagagacaacaccataacaaaaaggctttcacctagggtcctttagcctaagacactttattaacagaaataccacatcaataagcaaagtaagaaaagctagtgagcactttaattgatattaaagtattatttagtaaaatgcaactttcattcctataaacatttttaaagggaaatggaagctctctcaacatgagggaaagtatttccacagcaaagaaccaatatgtcattactcaagaaactccttaggccattcccatagaaaatataagcaaatatttaatgttttgaagtttatcgcagaacaacacacaaaaaatattttcaaagtagaaatagtgacaacaaagggataaagataatattatttgccttaacatataaagaaaatttaaataaccaataattttttataatcttaggaaaaaataatgatctgaatacaaatatatatacacatatctatttcttatacatatttcaaaatgacattacaaaagataaatcacttaggaataaacttaataagcatcataaaaacactgaaaacaggaaaataattgacagtatatcatatttacttaaactaatcaattctccctaagttaatttatagattgaatgtaccctatagatgattctttttaaaaataaagaaaatgtttctagaaatcaactagggggaaatcaggtaagcatgtccaataccattctgaaaaagcaattctggattgaaaggagcaatctcttatctatccagaacataaagtaggagagcctgctgtaggatacaagattaataatcaggctgacatacagtccccaaacagagccaatgatagatgagaaataatatgaagaatgaatcaaaaacagtgaagaaagaccattaaataaattatattaagataaattaaacagaaagaaattaacttaaattcatgctttgtaacatcaaaatagactctttttttaaactttcattttagattcgaggatacatgtgcaggtttgttatataagtaaacttgtgtcacaggggtttgtcatataaattatttcatcgcccaggtactaagcctagtacctaatagttattttttctgctcctctctccctccttccccctcccaccttctaccttcaggtaggccccagcatctgcggttcccctctttgtgttcatgagatctcatcatttaacttgtaagtgagaacatgcggtatttgattttctgttcctgctttagtttgctaaagataatggcctccagctccatccatgttccacaaaagacataatctcattcttttttatggctgcatagtattccatgctgtatatgtaccacattttctttatccaatctgttactgatgggcatttaggttgattccatgtctttgctattgtgaatagtgctgcaatgaacattcacatgcatgagtcttaaaatagactcttgacagatctaatctatcaaggaagtttttttccaaataaagttaaactggttacacgaattatagtccatgcacataacagaatatgatgcagcagtgaaaagcctgaggtcagccatctcttgggtagaatgaattcttgggtgtcctgctaagtaaagaatgtaaaggtacacaactgtggccatgggacacttccaactgcagtgttgaaattgctttgactttgtacatgtattgtacttccaaaaagaacaaataaactataaagaaacaaatgtttaaaaaccaacaacaacaaacatcaaggcgcagagaacaagctgaaattagaagacaggacttatctgatccttggaagaactaaaaaagtgatgacagaaatgactgacaaattcaactgtatgtacagccaaaaacctcatgacaactcacaaaaccaaaatttagaagacaaacaacaaaatgggggtaaatgtctgcattaactaaggaagagttaatatttctaatatgagattacactagacaagaatccaccatataggcaaatcacggcgaaaatatacacagtaaacaaagcatggaaatatattcaaccctgcaatataattaaagttgtaaaaaggcaggatagtgttatgctgaacattttcactttaaaagacccagtactagcaaggctataggaaatttggtatcagtcttttgctgaggtattataataggtacacgagcaccttttaaaaagcaatttcaaagtgcacagaatatgccataaaagtggttataccctttgacccagtaatccaaatgttcaaagatattcccactgcaatactaactatacaagtgaaaaattttagaaatagctgcaatgaacaaaagtagaagtgtggcaagggaaatcatgacacacagtgtgattaagaataaaattaagaggcttataactacatgggcacaagtttaatgacaaaaagttaaatttaaaaactcaaaaccctgaattttggctatattataaatgcaactatatttaatataatgtacatacaacataacaaagtcccaaaggaacatggaaagaattttttaaattctgtcataatgttaaaattatgatggatttaagcattgatatcattagagcatattaacaatacattacaaggggaattataaattatttttggaaaatggcctgtaggcaggattgagacaggtaaatatttttcaaaaatttccccagcatgatatgatacatcaatactggcttatttgattctacatatctaaatggataatcaaagactaatctagaatgagagctagaagaaaaagactttgactgcatctcatgtctgccaaggtcacctctggagtccagaatacacatctgctcttattagggtctctacctgttcatatggaatactcctagttcttttgattgttggcctgatcactgtctcccagatgttttcaagggggtgggggtagggccaccgagggacagtggctcaaggactctaagtctctctccaattgagggcacatgacctctacattcccattatagaccccagaaagttatgtgtgaaggaatgtgtcctggtgtgtccctgaggctgtgttctatgaactcaaatcctgtgcttcagtcccagtgtctttaagagattcactttctaacagccaagaccaattcgtagtttagacaaaaacaagacaagcaatcagctcaataatgcactcaatctctcgctccctctttctctctccctctttctctctctccctctttctctctctctctctcaatctctctccctcaatctctctctccctcaatctctccctctctctccctcaacctctccctctctctctctcagttctatccccccctctctctcaccagctccaagagtgcacctcctcctgcctttggtgttgataatgtcaaaagtatcaaagggcaaaatctgccaaataagggtaaatcagaaaaacagcagctggttcagaaagagaactgtggcactttacggagcagaccacttacagcagcacccacacaagacaaagctcagtaagtcagccatactcattattaaaccatctaagccagggagaaaacgaagatgatggtctgaaattcattcataggatttcaatacaaagctggttttacctaactttacaacagccagtttccactgaaccatgtcacagctccacaagaaaagccaaatggctcattatgtgaaaagttccaatgactgttttttaatgtttagcagcagttgcttggctcggccactgcaacaaatattgctgaactgtttaacttacaagagacatttaaaagcaaaaaagcccaaattctaaatatgcaattcataaaatagcatattttctttaattcattttctcaaagtttacaatatctgtactaattctctgtaactagatatgttctggatacattctcagagaatctgtgcagaataaaaatttgaaacatcttaaaactaactaaaaacatctttctagtatgctgcaaggcaaatgctttttagatgttttgcatttttatgctaaacagtgcagctgcgactgataaaaagcaatcaagctaatttaagtcaatcaactccaggaggttctcatcacttggataaaaatgctctctcactccttagaaaataaataaagatttaacagagtgactgcattttcttgactctgctttcttgccattccaaaggcagcatataaccaagaagtcatgtcaagcaatttttgtcacaagtttaaagcataatgcaaacttttaagtcatatttaattaagtaatcctgggccatagcacatcaacagagaataacaaaccttgagtgagaaaagacagacagacacacacacacacacacacacacacacacacacattggcacacacacataggcacacacttatgaaaggtacaaaattttcattagagagaccatcaattcctcttcagtctttaaggagagtatcacattaaaacaatttagttctggctggttgtcattattaaaaggtgatcctggaatttgaaaaatcactattttaaaattcgtaagttcaggggtaaactgtaaagcagagttcatgcacttcactaagttcatacatatattaggagaaaaccaggagggatggttacaaagtattttactaaaaataaagataaagataatatatgttgaagatttagtgccgaagagaggaggagccagtctaaatttcccatttccaccgggaggtcaacaccacactcctctgatgcctgcaaatatgacttacataagttcaagcagtagccgataaaggcccatcatcagacatattagctacctaggcagaaaagatccatcaaagccatttggtctttcaataagtgatccccaacaggcaatataaaaaaaatcagaaaaagcttatctccctctcacagtgtaaaaccctggccaagttactgagaaattatacatatatctttctcaatctaataggtggggtgttaatatccattctgaaaattaactatctgacagggccgagcatagcagtgctaatttataagagatatcagattctatatcagagccatgtatgaacacaatttttctttattaatttactgaatatagaaagatgggatacattaaggaaaagatgacaacaaatgaaagaaagagctggaacatattactctctaaagcttctatgaaattagtcatgtgaatagtactgaaaagatgaatcaagttttttaatggagtttcagagcagaaaacactaaggagcatcagtccctgctgaccataaagatacctcacgcttgctgttgagcaagaatgtaggaaaataccttcatatagcagccctctatgatttaatgcccacatatggaaattccacacactttgcagtgggtatatgtgtgtgtgtgttctctaggaatgtagaatgttacattaaaagaagaaaactctttctatactcacaatacttctgacaccaaatgtatggggttttcacatgaagcaagtctccaattctttgcagatacaaactgggtatcctaaaattaaactcaattccgacactatctactcagaattagcacagacctcacaggttaaggactcagtcacacaagactgccccccaccctcccacttcagatgccaattgcatgtagtgggtccccaggttacctacacttccatctgacttaattataaatcaggggttcccgtaatcccctcctaagttttggaaatttgctagaatcgctcacatagctcagggaaacatatcacttgtgaatataggcttattactgtcaactgaagaatcataaggttcatatatttagagaggagagctttatttcttgtagagagttgcagcctgcagcctggccatcctgctggctaagaggtgtatcctctggcagaaactaaaagcaagcacttcaagggaggacagggcaaaacaggagttcatgccaaatgggttggctaagtatacatatttaacaggttgcaaaaagagctatgaatattcatgaaggaggcttgcatgcacagtaagcaaacatgcacgttacatacatcccatgttcactttggagtggagacttaacatttaaatgtattaaaattaagctctatatgttaaaaggtgaaacggaggacacaggcatcctgtatgagtagcctctataaaccagccagaggaagtccatggtcagtggtcttctaagaaaaaaggaatgctagtcagttattgtgtaaatcagtggtggagcaaatttttccaaagggctggtttccattcaacccttacgaaagaaagtctaaaggcagttatctagggagtgggtataacaggcatgtctgacctcccatcatgtcatggccaggaactcagtttttaaggtttctctggggttcctttagccaagagggggttccattcagtgagtagggggattaggattttatttttctttcccattataaaggatacaacccaggaacaaacaaatggaagagatgcatagggcaacacaagacaccctcccaccacttcagcatgttcaccagcctgaaactgcccttgcaaagattagaacagtgagaaaattgtaacagtgaaagagatcggacctaaccaactccatcttgcctttaacctccaagctgcctttttcattcccgggtgtagagtaaactaactttgagaagaattgagttgatagtttaattttgaaacaaaaatggtagcccctccctgaaacaaagccttccttgcttggggaccagattgtctttgtaaagccaacaaattagccacaagattagaaatcatggctcaggaatcatgcagccagagacctcaagattcctaacctccccaattccttgtatggataacaacactatgtcaaacctaagattggtgtttaaggtatttttcagaccctgaattctgatggatcagctggtgccactaagaccagtaaattggctcatctggtcttgtgggccccaagaaggaattgacttccagtctcccctttggccagctccacatgcattaaactctctctattgcaattcccctgtcttgatgaattggctctatatgggcagtaggcaagataaacccattgggcagttacaaacccagaagctctctgaaccccaatgtttagggttttgatagcagttccattacataggcatgcctgattcaatcactggccattctccagcccctatcccctcctcgaaggtgagacttggggagggctaaccatagggttggttcctctaggaaccagcccccattcttcaagagtcacgtcattaacataaactcaggtgtagttgaaaagggcttatcacaggtaacaaaggaagctacccttaccctagggctcagaaatgccaaaggttttaagaactctgtaccaaggaccaggatgaaaaccaaatataaatttattattatatcacaaacatatatatcacaggttcttttaattcccagagaaacaattttcttgcattatcaaggacctgagtgtatgaatcatgcctttttttcagtgtttctaatgctctgacatttggagccttgctgaccctccaaacaactaaggactgggagagactgcccctcccagagctagccaattcctagagattacaagggactcaccttttagcatgcctttcatatgcaagccaaccatccagaaccctcaccctaccacctcctgcattaggagcacacactgaaggccaccctccccctgctgtaatccctccagggccaggtacccaacaactaaggacagcccttaggccccatgcagagcccattgagattattcaaacgagctaattctaaaccctgccccatctcttctttccctgggaaactgctataaaggctcttgccatgtttctcctccctctctctgcctcctgaccgaccctagtgctttcctgtatggtcccatgtggcagggtgtgccccttcctcttggaagtggtaatgaactatcttgccagtggcagttgtctcctgatctgttgacctcaccatatctgaataaaaagaaaatcttttttaagacaataagaaatccatattttactctactttaccctagcctaaacaagtatagcccagaagcttggctttagaaatatttatgaccaagggtttgttggctgccatgaaattgtaagttataagggcagatgtacctctggcattgaacctggaagggtcaaacttgtcccccaggtaatgcagagtcaaggcattttcttgagaacagaatagcaagcctttacatcttcctgcaggaggaaatggcaggcatctacagaaggaacaggtgtatgtgcattgggacactaccacatacttgcagtcacatgttccagaaatattttattcaatattcataaagtcaggctcttcacatcttcccacctgtcctcccctttccagacacacaacatcatgagggattccctgagcacacacttcactctctctatctttgctcatgctgtgccctcaacctggaatgccatgccttcttctagccatttttttccatcaggattctattatccttcaaatcctggtttgccactgtaatggggccttcctacatgctccagcctgaaggaattgattcttgcccctcctctctgacacctctttcatgttccttgtctggctcttcctgggggaccatgtttatttctattataaaaaatgtatattaatagtgaagactttattgagtgctctgtatttggcaggcattatgctaaatttttcacctgcatcctattactgaatgcttattctcaccctttaaggaaaatattcttaatcatacctgttttacagttgagaaggttttggaaggttaggcaaattgtccaagaccacagtagtcaaaagataaatcctggatttgaacctggattcctctgacacaaagcctctgctctgaagagatggtgctgccccttcctgagctacatactgcctaggagggtaagactgtctcagtcatttgcaaatgctctcgctgtgcttggctcagtgcttacagtggagagtggatgcttaatggtcactagactgaataaataattctagtcatgtttgaaaattatgaattgcaattgttccttcattgtgctttctcacttatctggtaatatgctattacctggatttccccatgtcaatatgaattttacataatcctccacaggaaaccatttggcctccattctatgtaactagctgctaagacaaagacaacaggttcaagagacatttccatccttagaagatatcctcaacaatcatgaggagcatgagtagagcgcttggccccaaagaacactcgtatgcattgtatccatttcaccccttcctagtcaagtgaccttgcacctgtaaatcaggataagaggactccctcaagggggtgttgtgaaaatagcatgatgtaaggcaggtagagtgtgggcatgaagtttgacacatatagagtgctcagtaagctgttcaaaaggaaggagtaggaagagaaatcatagctacagctcactaaatacacaagaaaaatcacattcgatgagcacctgctctgtaaaaggagttcatccttgtctacactgtattgtcacttcagcatccaatgagctctccaaatgctcaacaacaggctggaggaaggaaaaggcaccatggcaatgagaaccagcttttctaagacacaggggtttagaggtgagcagattttagacagtgaattgactattctgagcagaggaaatgcaaggaagaagccaccccagggagagggaatgggccagcctggccacagggatagctgaagcagcccttttaattattctacctctatgacccaatggccagaatagagaatatgttcagggctttggcattagactggctggagttacaatcctggtctgccacttcagacaatggggcctagagcaagttactcagcttcctcatctgtaaaacaggatggccttatttatagggaccatgctgagcacatgctagacatagagtaaatgctcagttaatggtagtttgttactaatatgagcagggtctataaaatgggatacttctacctcagaggatcattgtgagggttcaaggagatgacacgcaaatctcctagcacagtgcctaaaacaccataggtgagcactaaatgtgaggtatgattgttagtagtgacagtaataatattgatataacatgcacaaagctcagctattacagcaggaatttcctagaaggaaacagcaagaaagaagataatattaagaagaaaaataaatagcaagaacatattatgtgccaggcaccaagctaggtcttttccatgtactaatttgttcctttacacagccttatgcctacgtagtataattcccagttttctaaggaagttcacactaatattccttttcttttttttttttttttttgagacagagtcttgctctgtcgcccaggctggagtgcagtggcgtgatctcggctcactgcaagttccgcctcccgggttcacgccattctcctgcctcagcctcccgagtagctgggactacaggcacccgccaccacgcccggctaattttttgtatttttagtagagacggggtttcaccgtgttaaccaggatggtcttgatctcctgaccttgtgacccacccgcctcggcctcccaaagtgctgggattacaggctcgagccactgtgcccggccacagtaatattcttaagcaaggcttggcaaattgtttttggtaaagggccaggtagtaaatatttttgaccttgcaggatatccagtctcttttgcaacgaattaactctgccattgtaatgcaaaagaatctatagacaatatgttatgaatgggcatggatatgttccaataaaactttatttacaaaagcaagcagcaacaggatatgtcctgcaggccatagtttgttgacctctgctttaaaccattgagattttgaggttgttaccacagcttaacacagaccacactatctgacataattactaccacacttgacaaaggaaatcttgttaaagtgttgcagagaagcaacagcacttttgcatttctctatgagaatatttgttaaaatgggatcatgtgaaattgacttgggttcagattattatttaatctggctaagtcatatctgtgtgatttctatccaccaggaaaaaagtattaactgaacctctggctggaaatgctgtgccatccccttcttccctggtttactccaactcatctttcagatcacagattaagcatcttttcccagtaagcccagcctagaaccaccttttactcttgcatagtgcttagcttccttttctcattataattgttttactgaaattacttgattaatatctttctcttccagagatggaaaactccaggaacactggagccatctctggtttattcactgtggcatccccaatgtctaacccagtgtttgatagacatagttggaactcaataaatatttgttgtaccataaagcaattaagatgaatcattagtagtcacctttcactggtagttcacagcgctgcaatgacccatccaaggtaatgaaatgatatgacagagctataattcaacccaggtttgtcttgatatccaagccttgctcttaaatagaataccccactgcctcccagggatctggagataacaattgtgggaaataaaagtaccaaagaaaagaccatcttagcaaaaaggtagagaagtatggagggagttgagtaattgccttcaaaatgagaatgctcaaaagttttctttggtttactaagatgtttcaagtgatgactaacagatgtcttttgtttggcctgcacactattgcaaaataatttcttaaattagttgccagcattgaaaaaaaagagagagagagagattctacccaaaagtctggatttcctgcttctcttagagtcagaagatctggcaacactgggcctctggttcctaaggggaagcatcagctttcgattgggcgccggctctccagttatgacagttcccgctcagccagtttctctgatttatgaaacccacttggaccctatcacattgatataaaaacccatggattttatggagattcagtggaggcaattttaagggaagaggactatgagctaagtagaatggcaagagagagtgattagcttccttttgaaaagatatccaaagaaaagaagaaaggaatggagagagggaagagagagattgtagtgttgagattagaagccaaaatgaaactattgaggaggtgggaggttttcacctcagctgtaatttttttaagtgtctaaataaacaggggaagtaagaaaaggtcaaaactctataaagcagctcctgacacatgtagtgctgatggagggaatgtccacagaatgattcttgttagaatgatctgatatagtatcctgtgatgcagagggttcaaatatctgaaaagagttaccatgtgcaaaaatcttagtaactatttcattcagaccttccacacctgggagctttgattaagagcagggatcagcaaactacattctatagagaggtccaccattttgtttgccaggccatctgataactgaacttcaggtccattttagagttaatgttggctggccagtaaatttaataatcagaatatgttatatactataaggaaggaagattgcttcagttcctggaggtaaaagtactgataagtctgaaaaggaaaacaaaaatgaccccagaatcatgcagctggaagagcagtgaagtcaggacagccctaatttgaaatcctgcatgattactgtttagacctgtggctttggaatatttactttacctctaggcctctgttttctcacctgtagaatggggatagttctatctattttgcaagattgatataaaaatttactaagacaaaacttagtaaatgtatatctgtatgtctgtatgtatgtttgtatgtctgtagcacatacaagtcactctttctcggttcatcgatctttctgaaataggtgtagaaaggttaactatttgcattaactcgtattgtctttacttttgaaagtattagcaaaatgtataattgtaatacaataaaaacaattagaacactcctggattttcagcaagtacaatgtctttctctaaaacaaagatgtattatttcaaaagtatacatggcttacttgaacctatatacagaaagcatatctattatgagtatccttatgacttaagttatttaagttttttatattaattttcaaaaatacaaatgctccaactctcaaagattaaaagtccaggcattctgtgcagttaaatattttttcttcttaagcaagagtttttacatcttaaggctgaactttgaagatactgtttatcttttgcatgtttaattaaaactcttaaatttaattcagaaagtctcattaaacctatgcctttagaaggttattttagcaaagcttatatgtgtatatatattttaaactaggtgttaatataaacatgggcgttttcttcaagttttttctcaaggaaactacaatgtttgaggcttaccgtgcccaggagtttcaattcctccctgcagcaacagaaaacaaagcaaattgctgccacatgtgcttgacttcaatccacaccaactctatggatcccacctacagctcagccccactccagggcagagacacactactgcacaactggcaactgacaaaggacttcaccaagactattttggctttgccaaaatggatgaaaggtcacatagtaacatagtctggttcttaaaaataagtttgtaatggcagaaacattggaaacaacctgtttatctataggggaatgatgaactaaagcacggtatgtggagtaatgagtagccattgacagggaggcaggtcagtatgcacagatgtagaaggacctctcaggcacaacaagtgcaaaaggcaaattattgtatttcgtatcccatatgatttcattatgttgggaagatcccaacaatatacatataaatccccacacttacatacagcatttaaataatctgaagaatacactccccaatgataatggtggtggcccctggagaaggggtgcaacttcagtgtgtttggaaagatgcaagagggatttattctcggtttaaaattttttgttttaccttaaaaaaattttttttgacaatgcaaatgtagttttgcattactttatgatttaaaaataaatcaaagccatccgcaattccaaagaagtgttctccactataaagaaagaagtctggttgtcttattttggcccattcaggttgtggtgagtagagacatattcagatttcaccaggtaaagagggcttatgagggatcacaggtacccagaaaactgtaggcaataggatggccaggtcttggggagaatgatgactccctttctaatttaccagagcaacgggtagctcaggaaaaatgcccgaatgcccgtaagtcttataatgcaatctccttttgccactgcttctgctgctttagcaacaccctcctgtctctccacttcatgactgttgcttgctcctggattctgctgtctcgtcgcttctgctaagtcccttctcttcacacctctcttaatttctctgctactttatgggctttaagtcttcataccgcaagttcaaccaccccaagaaaacacaaagcatagttgatgaacttatctaccattcaatacacatctcttatctcatttaatccttgaaacagctgttgcccattcagttattccacaacccagtaatttgtcctcgattcctctcttcccaacctcctccatatccaatttcttcccacatcctgacatctgctatagtctgaatgcttatgccacccacccccaaaattcatatgttgaaatattaacctccaaggtgatggtattaggaagtggggccttttagaggtaattaggtcatgagagtggagccctcatgactgggattcatactcttgcaaaagagaccctacagagctagctagcctttctttcatgtgaggacacagcaagaaggtgccatctgtgaaccagaaaactggcactccccagacatggagcctgctaggaccttgatcttggacttcccagcctccaaaactgtgaggaaaaaaaaaaattcttgcttctaagccagaaattaccagtttatggtaatttttttataacagcctaaagggactgtgtagacactatccttccgaaacatataacaaaatcattctcttgtctccatttctacaaccatcactggctacagaccactgtcactcctcaccaggatgtctgcaatggcctcgcagcctctactctggctccacagaggccattcctcacacagcagtcagagtggttggtcttttaagaatgcaaatcagaccatccacccctttgcttaaatacctcctgtggctccccattgtactgtgtctcctctgtaatgccggtcttgacttcctccccaacaggcacattaatcaccagggtttttgtagttctttgtttctgcctttattattgaatttactctctagtgttatttttggttctgggtctatacataaggacgccctaaggacaagggtatgtcgcctaacttacccagggctttctcagccaatttgtattacagataattgttaaagtccattctaactatggccactttgcacatatgaaagttttataaaataagaaagcctatcagaatcaggaagtaccaaactcctaggattgatttaaggattatttgacattacagatggatttggcacctgtaagtgtttaataaatgtgatatgctgctattattttattcttaatgatatataagacttcctgttggcaaaatgtgttaaattgcattaatgccattagtgacttcattctactgatttttccaattacaagcacctaagggaaaaatactttaattatgtcagtcatctgtataaggcatcagtttgccagtaaaaataagaacataagaaatattcctgacttgaattacaaatttcagcttacagaagtataacacccaggataagggtgtacgtaacaatttatctctaaaggactggcacgaagcaccatgaagatgaagacaaatgcaaagctctattcactttttcatagtggtcaatcaatgcaacatcttcctgggttctgaaaaattcccaaaccttgtaaagattctttgatctaaacccacacttacagtagctgaaaggagggaattgagcaaaaccatacaccacagaaggaggaagaaatataagacaagaaggctccattctcaagaaactgagagtcaatttagagaacaattctggaaactcaatgttgagtactgtgctaaggcacagcagacaaaatgattcaggagacatcatctagagatgacgagcaccaacaggtgtctgccaggacataaaaatatgtggagaaatggagatgagaaatatggccaaaaacaaagaaaaaagtgggaaatgagctcatcaggaactcagctatataaattctataactgaacaaaagaaatgttttcaaatcactgtcttattctctgaaatcttacataaattagtgagcatccttatctttttttgctaatctacagtacattaagatatcttgataatgatcttactctattgtatttcatccaacatgtggttttactttgaaattcactttctagagaaaatgagcttccttcttctagactgggatttagataaactcaatttacaaaacatacgttttaacaagtccatattgaatctgcttcagcctggagaaagaataaaagaaaataaaattaacaaggtcttattccctgtatattatctttcataaatcttctctctttctaaaatatgtaggataaatatttaggattccttgaatcaggcttatgttttactcatcagaaacacctagactgtaagattcacggaagactccaagcaggcaaaataaagttttctaaactttatttagaaatctgaactgagagtaaaatagaaattaggttccccagtgactgataccaatgtgggtaaaagagatgatgtcaagcaaaaatcgtgtggccatcatctgtgcctagcagcccaaggcacttccagggaagttatcatgaactgaccctgactaaatggagtgagtcatcagcaggtccctgacatctgccagctgcaaagtcttacagcgactggctagattgaaaaaagatttccgaaagtttcaacataaaaagcccaactgattccacttccctatcagatttccctgggcttgcttctaggtcttttacatccaaattaccctctcataaaaacaaagacttagaaaaactgcaaaaagttaaaatgactctttccttctgaaagtatactttagctgagtcgataaaaggtctgaaatcatctttatggttgccatcatgtttggaataatttagcagcaacaacatctgtataaatgaggacatgaagtcccaaggtaggtgggagacttcctgtggcttatccatgtcaatgggaataaaattcaaagagcccatgcaggcaactaatttacttttatttcatttttaatgttttattatataaatatcaaacatcgacaaaagttgagaaaataatgtaatgaactccatgtacccaattctcaacttcaacaagtatccacttagggctactcctgtttcatctgactgcactctccctccccatccccctgattattttaaataaaatcccagatattacatcatttcatctataaatattttagtataatctttaaagataaggattccttatttttaaaaattccatcttcaaactttagaaaaatttgccaagtttcattttttaaaatggcaacaaaaattttaaaacagagtcatttgtcctactagaatttcccatgatggggagcttgttcactatatgcaaatcaatagaggtgatacatcatgttaacagaatgaagaacataaaccatgtgatcatttaaatagatgcacaaaaagcatttgaagaagtttaacatcccttcatgataaaaactctcaacaaattaggcatagaaggaatggactccaactagtttgatgacatgatcttacatatggaaaccctaaacacctataaacccaacactgtgagaggttgaggcacaaggatcacttgaggccaaaaatttgagatcagccaggcaatacagcaagacctcatttctacagaaataaaaataaattagttgggtgtggtggtatgtagtagtcccagctacttgggaggctgaggcaggaggattgcttgagcccaggagttcaaagctgcaatgagctatgatggtagtactgctctccaacctgggtgacagagtgagatcttgtaagaaaaaaaagaaggaaggaaggaaagaaagaaaagaaagaaggaaaggaaagggaaggaaaggaaaggaaaggaaaggaaaggaaaggaaaggaaaggaaaagaaaggcaaggcaaggcaaggcaaggcaagaagggaagggcagggaagggcagggcagggaagagaagcccaaacactacactaaaaaaccctcagaactaatcaccaaattcagtaaggatgcagggttacaaaatcaatatacaaaaatcagtatcatttatataggctaatggagaactatgtaaaaaagaaatcaagaaaacaatcccatttacaatagctgtaaaaaaatatataaaatacccaggaataacaaatgaggtaaaagattaccacaatgaaaaatataaaacattgctgaaagaaactgaagacgacacaaataaaccaaaagatatcccatgttcacggattggaagaattactattttaaaatctccatactacccaaagctaactacagtctcaatgcaatccctattaaaatatcaatgacattcttcacagaaattgaaaaataatcctaaaatgtgtatggaaccacaacagatcccgaaaagccaaagcaatcaagcaaaaagaacaaagctggaggcatcacaccacttagcttcaaagtatactataaagctatagtaaacaaaccaggctggccgcagtagctcacacctgtaatcccagcactgtgggaggctgaggcaggcagatcacttgaggtcaggagttcaaaaccagcctgcccaatatggcaaaaccctgtccctactaaaaataattagctgggcacggtggcagatgcctgcaatcccagctactcgggaggctgaggcaggagaattgcttgaacccaggaggcagaggttgctatgagccaagatcatgccactgcactccagcctgaatgatagagcaaaactctgtctcaaaagaaaaaaaaaaaaaaaccagcatagtattggcataaaaacagatacatagtccagtggaacaaaacagagagtccagaaacaaatccacacatttgtagccaactgattttcaacaaagatacgaagtatacacaatggggaaaggatagtctcttcaataaatggtactgggaaaactggatatctacatatagaagaaataaattagaccctatctctcaccatatacaaaagttaactcaaaattgtctaaaaactaaaatgtaaaatccccggaggcggaggttgcagtgagctgagatcgcctgcactccagcaagactccatctcaaaaaaataaataaaaataaataaataaatttttaaattttaaaaaaaagatttgtaagtgaatagtgctccaagcaccaacacaagctctcctattcattaggtacttccatgcacttaccctgtttatatgctcaaggtctttgtagggcttgttttacagttcactagactgaatcttctatgaatcaatcctactggaaactcaaggacaaaacaaactccaaacaattcttaagcttattttcaataatcatattatgggtagtaatgttggtatttatttcttgtttatatctgtgtctccagcacctaggaccatgtaggcaatttaaaactgacgcactggagatccaataaaaagcttatcaaaatgatcacctaatacacacgtacacctaatttccacatctaagtgctccatgtctttctcacacacacacatacatacacagggcaaaatgcaaatgtggtttaagtttttccaaattaaatgtttaaaattgatatgtgtccttacccaaatgtactttttgaatttggatgagaatgaggttgaaaagttgacaaatcctcatgccactccctcagtgacacctaggtctctgaacatccccagcagttctgtgacccctcctgatcatttctttccctccttctggtactactcttagaagagctgtcaaagacagtcatcgctgtggagagagctgacccttctggccctggcattgctggggctgggcaaaggagtcacactcagtaaatgaggagttggatcttctcttttccttcacatttgaccagatcttaataaccaaacacagaatctgtcccgtttcaaattagcaactgccaagtagtattgtaggagccagacgttgttctgttatagtcataaggatttaagaaatcatctacgtttgaaaattttaaaaaatgcaataaaataaatttcacagacctcaaggtagaaatgcttgcaataatgccaaactcctaaagttaaaatgatccttaactacacaacttattacctcaagttgtattcctccctttttcttaataagacaaaaggaggaaagtatatgtctgcatggaataaatatctgtatttaatttaagaaagataaaagttcgtatgaaaatgggtgaaaaatccttgcagaagccctgctatttaacttcactcttgacattttggtttgctgtgtaaatatacgtaaagaaacccaactacagcaaatattagcccttttccaggggaatggagggaagtgtgacaaacgtggatccagtgtcaggaaagcataatcacaatgtaaactggttatttccaaatggtgcccctccaaagaaaaagaagggaatggaagtacttaataaattctgttttccataaaattcattttaaaaagagtaaagaatgtgaactcgggggtcagtaagagttttgttggatttccctcctcctaaattctgtcatctcctttttaaagtggccagtcagcttcccacagacatgacagaaatacattctttttcttcctgcaaaccatttaccagtaagtaacacttagcagaggacatgtattttctcacagacgattggctaattggatattgtcgcttccacttgcagcttaatatattatagacaatgactttttcaaacagaagtataaacaaacaaaagcactaatgatccattcattttctttcaaagaaaataaagagctctgactcgatacctctacaccccaaaacaatggacacagattatgaacagatttaatgtagaaattaaagtgattctgttatcttaattacatatttggtcatacaggtcaaataacatcctaatgagctcaaaaagaaggtccaaattcttttgttccactggaaaaataagttgctcaaaatacattgacaatgggctaaggtttggaaagtttttgattaaaaaaggatttttgttggaacacttataatgagatttgagttgcagtaacaatatgaaattgaaagcagaattacatacaaaaagagtactgtaaaatatcattattttagtacaatggaaaataaggtgtttgtggttttactctataaattctgtgttgtctgctcatatgtattccttcttggccttcctctgaatagccattctgatttccaagcccttctgcaccagtactcatttgtggtggggggacccacacaaaaaacatctcctaggctctactttcttcctccattttattggcttttcaggacgaattcatgtacacccatcacattggtgttcagttaccgggcagacaatgaattttcctaatccatttagtgtgctgacagagccatgttcacaatttatagaatttccttttagacatttacgtatttcacagttcattaagattcaaactgaacacctgtgtttataaagtcaaaagcaattttatcctaacaaggtgttaaataaggcgttctctgaaagcctgaacaacaataacaacaacaaaagtactagactcttgacctgtagaacaaaatgatgcctgtagctacctgcaccatcctttaatagtccagaatttgccacagaacaaccataaaaagcttttatgacaaacttgggatgctcccttccatcacatttcaatttctccatcacaggtctttcatgttctgccttaagaaagcaatagcatgaggccactctgcaaagttcacccaggtagctaaaatctgcaaaagagcttaaaaactttagaaggtaaatgtggcccctatagacaattccttcatttgctagatacagggacattttccgcattctaaggctcacaaagcctgaccttgcctcatttgtatgtgaccccaaagttttcacatcattaataaaaagagaatcaaaacaaagcctacagacattaggggaggggaaagtgtgttgtttggcactaccatcatccatactctcaaaatggaaagggaaaaaaataaaatgcacatagacgaggtggtgacccctataacgactatggttcccaacattttttttcctactggtaataaaccattttgcagacctcccaattgtggccaccatgatagttactgttttgcaggtttatgtctttttcttgtagttagaagtgttatcaataaaaatttcaaatgaagcctttcccgtcaaataaaaacattttaaaatgtgaagccaacagcaggattagggaggaaaaatacaaatgacaccagggctttgttttgtatatatatttttcttttaccaagtcccttaattgattagttttaaagacattccttgcaagtcttgaaagtgagataaatgcatcctaaatggcactggggtaatttaacagtcttaaaagttgattttgttgtatgctactaacttttctaaaaagcatcttaattttgaatgcagtgactatgaagggcattaaacaaaaagctatctcagaaaggacatttaaatattatcctttgaaggctgaactgattaaaaaggactttactgcttgccagtcaattatggcaaggggtgaaaaaaacctgaaattattgtttaaaagtaaactggttactaaaggataggagaagaggggtgaggggcgaaagggaaaggttggttaacagatacaaaattacagctagataggaggaataaattctagcgttctgtagcactgtaaggtgaccacagttaacaataatttattgtatactttcaaacagctagagaggatttctaaggttcccaacacaaaaaaatgataaacatttgtggtgacagatatgttaattaccatgaattgatcactacacattgttgacatgtatcaaaatcaccgtaccccataaatatgtacaattattacacgtcaattaaaaaagtaaaagatcacttcttgtaaatcccaccttatatgctatggcaaatactatttccaaccatttaaaaaactcttttgctccaaatgggtcagtcccaatgaataagtagttcttttaagtatttggaatagtttgcaaagccccgtgtgaatgcatacagtcccacagtccctggaggccacaaagcattcccaactccttgtcatggttacctttaatgcccaagagttgtagctttaccaagaactgggggacagagggcccatctcaaggcaaataaactgagaagcaaggccatgtaaaatgtgttcttttctccatgtaacaacattttcattctcaaaagtttggtttttatgattcatcttgcaaactgacagcccaagtctgctctctagtttgtgttatcacactgagtcatctgtgactcagagacagaaaaatgctgccacgggctcagaaaacacctcctcctccaccagcaccttacacaacctccctgaagaaattatcattgctgcttctgttaaaaattcatttaatttgggaggctgaggtaggagaatggtgtgaacccaggaggcggagcttgcagtgagctgagatcacgccactgcactccagcctgggcgacagagcgagactccgtctcaaaaaaaaagcatttaattttttttactataaatgtacgacatgtgcatcatcatagaaaatttaaagatcacctgggtatccaacaatcagagagaacaaagtcatacacagccatccattcttttatttgtttttacatagtgtgcatgcatatatgaatatatgtgtatgtatgtgtatgtttgtatatatataaacgtctttaaacatatttaaggaaataaaaactaaatattatatgataaacttttcttaatatactaggattctaaacttcctgaaaacaataccctccctagagtttgggcaatgaccttcattattatggccatagtgtcactattattatagccataatgttaccacgaggatttaagcctcagagttattcattcttatcccccttcttagccatgtcagagttatgcctagaaagcattcttgaaaattccgtgaactcacctgtcaagacagaattataaaacttgccacaaattttgcctttaagattaaatgaggccagacatggtggctcacgcctgtaatcccagcattttgggaagctgaggcgggcaaattgcttcagcccaggagttcgaaaccagcctgggcaacatggcaaaaccctgtctctactaaaatacaaaaattagctgggtatggtgttgcatgcctataatcccagttagttgggaggctgaggcaggagaattgcttgaacccgagaggcggaggttgcagtgagccgagatcatgccactgcactccagcctgagcgacagagcaagaccccgctgcaaaaaaataataaaataaaataaaacaaagattaaaagagataagtcatcttcctgacatgaagaaagccctcagtccactgggactctcatggaaatcactagattcctagttaaaggcatttggagctgggaacccagacattgccatttacctctgtatgaccttgagcaagttatacatcctctgagcttctatttcatcatcttaaaaataggggcaacaataccaacttcacaagtggtgagtcagttttaaaatatcacatggaaaacactcagctgcatctcctggaactcagtgtagcagccataagacactcagtaataaaattacatttaaaaggctaagactatcagctcttgaaattacggatccccaccttgtccagcaccttgcacagcatagatgcccagtattatcaatattatcaaatattatcaaatgacacctcactgatttggacacattgtgggaagggtctgtgtgacataccaccagctaaagcatttccaagtctatgcaggaactcccgaaataatgaagctagcagaatgcctgcaactccataaatatcatctcttttctcaagaaggagaaccaagttgcttgagtgtgacctcaaagaggatcagctttaatcaaaagatagtctcaatattattagggtaaccaccttagcaatattagccttcaattataagagatacaaatagacactttgaacagttgcatattttagtcttcaagggagcgaaatatctatttcttcgtgtcttctttccttcctttacttatctgcttttaaacaacaaaagaaagatcaagattcggtgtggaattattagtaatcaatgataatgaaatcactgggagtttatggtaccataaatcagttctctaacatatatccacgtgtctaaaagaacgtttgctcaatgatagcagaaaccatatctggcacatagtaggcattcaaaaagtatgtgttaaatgaaaaaatgcatgaagcccagagagcaaagattattaatgtgaagttcttggaaatgctctagagcatctataaactacctgaaattatatacactactgcatgtgaatattagcatgtatgtgcccatgtggattttttttttggtgggggggtttaattgcataagattctcatctgtgttgattatattttttagaagttatgaacccttgctttgcagctgccactatgttgcccttgcctgcataaacacaaaacccctgcattctttgttaatgaacgggttctcaagtgtttactcttagacaagtattatagaatccttctctggcttatttgggacagaaattagcattatgtaccactgtcatataacacatcttggaaaacacatgcaaaaatgttgcctggcagtttgcaaaccatgccgagttggagaaaagtatacttgccagaaatcagaaataaatctctctctttttttttgtttttttttgtttttgtttttgtttttgtttttgtttttgtttttagatggagtctcgctctgtcacccaggctggagtgcagtggcatgatctcaactcatgctcattgcaacttctgcctcccaggttcaagtgattcttgtgcctcagcctcctgaggagctgggactacaggcccgtaccaccacgtccagctaatttttgtattattagtagagatagggtttcacaatgttggtcaggctggtctcaaactcctgaccctaagtgatccccctgcctcggcctctcaaagtgctgggattacaggtgtgagccaccacacctggccagaaataaaaatcttaatttggagatagaacaaaagagatggtcactttcatagtatctttatttgtccatatcattctaagacataaaaaagtgactcaattgaagtatagaagtccgaggtctataaatgcacataccaaaaattcaaaagagacccacaaagtgaaacacagaacagatgtgaagatgacaagtgaagtagagtattcaggtgtgacctgcccaaacatccctgataaacataatagtagtaatgataataataacagcaatggtgataccataatttatagctgtaacccttgactataatcaaagcacttttcacatagatgtatgaggctgatacaatgactgccatttcatagactgtgacatgaaggctcagagaagttcaagtcttgtccacgccacacagttattgaatagggaggctgaggtataaccacacatctcccacttctaaatgctgtgttttgtttgacattttactttagatcacagaataaatgttaggccttaatccttcccagtttatggatatgttgttaattattcactgaaatccagaaaaatcaaggtgctagagaacaccaattcattattttctctactgctgtggaattcatgtgttggtggatggggtaagttggtacaaaggaaacatcaagggcagtagcaaaataagaaacttggccttagagtcctttgaagctattttaaaaagtaaaatgttatgttaagagctatgtggtgtatctctctgtgtatgtaattattattctattgatttattgcacacatgtcagagtgtctgggcatttgtacaagttcaaacaaaccaaccaaagagccaagccacatagccgcaaaccgagacagcttgcctcctacacctcaccccacccttcatcctaccaactcccaaatgcaaattccctggtagcaaaaccttctttacagagatgaaccgttaagccatgacgtctgtcatttatactattctaaaagagcagccaaagccagttgatggcacagatatagcaggactctccccattacaaagagagcccccttctgttttggcaagaactttcaggaatgactcaggaatcaaattgcaaggagctatcacatgtaacctcctttgaggatgagcaccatatcttttttttttttaaccttttattttaggttcacggatacatgtgtgggtttgttgtataggtaaattgtgtttcacaggtttggtgtacagattatttcatatgaatttaaattcagatttttcattgtagggcataatgaaacacaacatatctcatcttctgaatactcacccactaacacaccacacagcaggtagaaagactcttatttacctctgctatcccaaagagtggggaaatcactttaaagtattctacactgctgccaaaaatcctctgcccacaatccaacaattagagcaatttcaacctaaattgctccccctaagagacagacgtaattagataagtttctcctctgtttccatgtacaaagagatcttaaaaggaaaaaaaaggcaaaagaaaattcctcagccgtttccagctgataaaatcagtaatctcatactcccaacttcaaagcagaagacttagaaaatcatctcactttctctgcacacggagaataatttttttctacttcaaagcaccaactctttatttggtcattttaattattgaacatgggacggaagctatccacataatgtcaccactgtctttttcatgaaatatgtataggtctaatttggactacattaatttgagagaggtaaaatacagggaggggaatgagaaaggaaagaggacaaggaatatagcctccatcagtataagatagtgagaagaaaagcctttctgacctggctcctcattcattttctctggagagaaaccatcaagaaacctgactgctggtttgggtaagcagactgccttgcttctcaaattctctcctacccaacaacacacagcaacacaattacactaactttatcggtaatcctggtattattgacaaaatatgggtacaagcagttgctttttgaataatacagtgaagaaaaatgaatgctctagaacagctgtcagcaaactttctccatttagggtaccacagccagagagaagactagctgggcattccaatgcccactcaatcctcttcccacaaaatcacaatgccagaaattggcaaactttctgtaaaaagccagacagtaaatattttcagctttgtgggccatacaatatctattgcaactgctcgactctgctgttgtagcacaaaagcagccaaagacaacatgtagatgaatgggtatggctgtgttccaataatactttatttacaaaagcaggctcagggccagatctggcccacaagccatagttttggttgacccctatttgagacaagtactagatggtagaaatgttctctagctgtgctgtctaatacagcagccactagccacatgtaactgttagtacttgatatgtggctaatgtgactatagaactacagtttgaatttcactggattttaattaattttagtttaaatagccacatgtggctacagtgttaacacacaattctagatactattcactgctgcctcctcaaaggagatagaagccaacttccaatttatagtatagattaaatgtttgccttaaaaaataaaatacccatacctttgcattcacagtggaactatacacaactgaaaatggtatttcttttttttttttttttttttttttttgagacgaagtctcactctgtcacccaggctggagtgcagtggcacgatctccactcactgcaagctctgcctcctgggttcatgccattctcctatctcagcctcccgagtagctgggactacaggcacccgccaccacgcccagctaattttctgtattttttagtagagactgggtttcaccgtgtttgccaggatggtctggatctcctgacctcgtgatccacccgccttggcctcccaaagtgttgggattacaggcgtgagccaccgcgcccagcctgaaaatggtattttttaaatgtgaaatatctacatcattgagaccaaggtgattgtttcgaattgaagcattcaggtagctgcctatcagccaatggtcaaaggtataggggctgagtcaggttcatgctaagacctatccaatccagaaagtattttcttccgcctctggacactgtcgtgcaccttgactgaaagcacagatctactcaacagtcccattaactcctaaggccaatccaaacctccccacagatgctaaaatatatacatgcaaagacacagctcaaagagcccaagagagagcatgcatgttgattagaatgccttctaaagtaatgcacacagcacagtgcctcaacacaaaatcaagattcaccacatttttccctattgcctgctgcatttgataactattttatttacacaataactagcttgtgttttgcatttcttagcagacccaaagatgtaatccaaggaggaaaagcaaggaaataggatagtaacatatttttgttgttcttctaagcatgaataagagataacaaaccaatatttcctttgagaaactcacacaatatcaactttcttcaatgggtaaaagaaattgaagatactccttagtaaacaagaaccctttggaaacatgggtgccagaaggggaacccatacagaggatgcacagcaaagcaaggcagatgacattccagttattttatgatttttgataaaatgaaaccattctagatccaagcccttgacttggatttaccaaatctaaaatgctccgaagtatgaaaaaaagaaattccaagtgtgaaccaaacacctttggtggcacaacttgacacaaactgacaagagtctaattatacagtctttatttatcccacttagtataagaaatttttttaatgcaaaaatatgcatgtgtttgtttatggggtgttgctacaacttcacttgcagtgttacacaatctatacaatgcatctcacctttctgaaagcccaacaaatatgaatttcaaaatacatctggccccaagggttaggataaagggtctttggaggaaagttgttcaggtagggcaatttctatcaattcaatgtctctgctgtctagaatcctgagagagtgccttacctcagtctgaaggatggcagccctctgttctttggcagtaagtgactctttgagcacttcaatgtgttgcttgcaatctgaattttgattgctgagggtttcaagctttgtttgtaaggcaagaagttccgactctttctttgaaagttcctgcttcagctgatcaatctgcaaaacaacaacaaaattgcaagaaattagaaattgctgcccctacactttacattggacaactactgatttctctccatttcagcagccagtgatcaataatccaacaaggcaggccacgaatttgcttaaaaaagatggccttgggaatcacacagtctttgggttctggaggaaaatctgtaaaggtcactgagagtataggaaataggaatggaaaggtcagcagactgccctccatcccactgtggaccaaatttcacaatggaatgaagccttcccagccaaacctactcatctgtgaaaccaccaagtatattaccaccatggtcctgaggagagtcaatagggatctaacatgggtaattaaaccaaggcataactccacagtgcaaataatcattcaagggcatcatttgacaaaagaatcctaaaaaacaagtaagcactggggatcatctttttgcttacattaaatattgagaagatacaaaaagaacataaaatatacgtgaggtatgaggaaaaatgacccaaaaaatccataattcaattcaccaaaaaagatcactagaattacccatgtcctatcccatttctatctcctccccccatttggaaataattaccaccccaaattttgtgtttattatttctttgcttgtcttttaggctgatcatatatttttgcatccataaatatacactatttggttttgcatgtttttaaactttatttgggctacaattttttttcctactttgctttttttcctactcaatcttatgtcctgaagattaaatcacaatgttgtacatagagttcattcattttcactgaagtagagtattccattgtaagacttcaccacaatttatctgcccactctgctgttgatagaaattcggttctgttcttaggttttttgctactataaaaaatgctattctgaacattcttatacatataacctagttcacatagcaataatattctcaagtgtctatctaagatttaaattgctgaaccacatagcatattcatcttcaatttcactagataaaacaaaaatgtatgactcacacctataatcccagcactttgggaggccaaggcaggcagatcacaaggtcaggagttcgagaccagcctggccaatatggtgaaaccccctctccactaaaaatacaaaaattagccagctgtggtggcaggcacctgtattcccagctactcgggaggctgaggcaggagaatcacttgaacctgagaggcagaggttgcagtgagccgagatcacgccactgccctccagcctgggtgacagagggaggctccactcaaaaaacaaaaacaaaaaaatgttttccaaaacagttctgttaatttacatgatcacaagcaccttgcaagtatgccaaccactccacctcttcactaataacttatgtcactggtcttttacacttttgccaatttgatatgcgttgtgcaggtagatgatctgcagagacatcatctacccattccttcattccttcctacttgtacacaaatgtcgctcctcacaactagagctgaagtttatttaccctcttcttgaacctgggctggactgtgacttccttctgccaacaaatgcagcaaaataatcagtatacctgttatagccctagcctacagggggactggcagcttctgcttctacccactggaagccagccaccatgttctagaagctcaaccaccctgtgaccaccatggtgtgaggaagaccataccagacatatggacaggccatgcagaaagacagggaggcctgtggtcatggtggcccctttgtcttgtttcaggcctcaaagggaagaatttcaatgtttcatcattacattttgtgtctgcattggttttttatagacattttattaggcttcgcattattacaactataccaaaagtattttttaatcagtagtgaatttttaacattaccaaacatttttttctatatctcatggtttatcgccatttttcaactttcatatgttattgtaatgaattgcattaatgaaatttttaaccttaatctcccctggcattactatgaaaaactccactcgatcattacatattttttatatgttactggattcagcttgctaatattttgtaaggatcttttatttatgtttatgactgagactggtttataattttcctatcctatgctgtccttgtcaggttttaatatcaatatagccttccgaatgaagtaggaagtgttccttcctttaatgtgtttggaaatggttcctgtgaaattggaattttttttttacactaatgttcattagaaatcaccagcaaaaccattcagagctgttattttctttttccaaagaacattacttactaatccacttttaatggctgcaggaatattcacgtttctatttagctgagtcagtgttgatacatttttttccccaaagaattttttgtttcatctaaattttcacacttatttgcaggaaacgtctaaaaaacccacttatccttatatcaatagcatttatgattatgtcttccttttcatttctaatattctacattattaacctctcttttttcaagttttattttagctttaaccactctttttcctgatgaatctcagtagacacatgtcaagttaagtattcttatcaaggaaccaattttggctatattgattatgcaattacacttttattttctgtttcattcatgtctgctgcttttaaatatttccttccttccactttctttgggcttattctattttcttttcctaactttttaagttggatgtttatactaattttcagccttgtttcattcctaagataatccttcagactataagtcttgatttggttatctttaaatttgcttggtttcttatagtctcttgttctttattcatattttcaatctcttatttagacatattaaacacacttattaatatttcatagtctttttcttataattccaacttttgaagtctttgctttctgattctgctatttattctttctactggctgtcatttatggtggcctgttttcttgcagattttgtgatttttctcctttttttggtactgtgtactagttttttttttttggaactttatctgaaaaaatactttaaggcttatgtggtcctttagagaatttgcctctgccaatacctggggacactaccaaccaagaatgtagctgctttaagctacattatctacctgaagttttccgatcatcttgcacagcacatccatgtaacagccagctgtggttatggattctgagaacaaattttttcatcttttacttggctcaaagctttaaaacagaaaatcttccctggagtcccctagtctaagtgtgaggagggggaatatggtaaggttatttttagtttgcctctgcactagcagtatagctgtctgagatcccagcttcatgtggtggtggtaatagggttcctacaatccctcatcttaagtaggcccagacttctgtcttttttcttcagtgtccttgtggctatgaaaaccagagctcaagttcatctatctgaaaattgccaacaagaataaataacctgatatggtttggttgtgtccccacccaaatctcatcttgaattgtagctcccataattcctacatgtcatgggagggacccagcaggaggtaattgaatcatgggggaggggccagtctttcccatgctgttctcatgatagtgaataaatctcatgagatccgatggttttataaagggcagttcccctgcatacactctcttgcctgctgccatgtaagacatgactttgttcctcatttgccttccaccatgattgtgaggcctccccagccatgtggaattgtgagttcattaaacctctttcctttataaattacccagtcatgggtatgtctttattagcagcatgagaacagactaatacatacataacccatgctctacttatcacacaggcttcctgctatggcttagctttgactcttgaggttctttcttactcaagagctcataagtacattttaaaatatatgtttaaaaatatatttcattcagtattttttgttgctttcagcaagaaaactgacataaacaataacaagctactgacaatattagctgagcatgaacaggagtgagactcccatgttcagaagggttcaggttgcataacttagtagaaaggttgatatgaatggaaatcccatttgcaagaagtcagactatgtcagggaacaaacaagcttcatcttgctagccaaatctaaaggattggtagtggctaaacaaaaaacggtcttgagaaggatcctaagtatgtttaaatattcactgggaaagaatcatgactgcttatcaatgtgccccaggtatatgtgagcaagtgagcactgctcagatatgtgcagtttctgaaacacattatttctttataatttaatgaatcatgagtgtgtggtcatttttatgtggaacaaaagtaagaagttctctctctctcatacataacaagaatatagtataaataaaaacagggaaaatcagaattaggattatctaaaatgataaaagatactaaaatctgttatgatcaacactcttctcaggggggtatggccccaaattatatccagctgtagctgacagcacagtttatagttgattccacatatgaaactgattcatctgaaattgacactcaaaaactttcaactctacacacctaagcaaagatgatgtttatagtgaaaaaaccgattcgtgctaacttctacaaataccacagtagaaagccagtgtcgggtttggtgtattgagagagaaatgaaaaggaaatcaactggatatagacaatagggtttagtcaggaggaagggcatggcagggtctacatacacctcctttagtcaataaaaatagattgataatgataaaactatttcagtctataaatattaaataggcagtggctctaaatagctttcaggcattgctgccataaggtaaattttaaataaatatttatgtagacaataacagaaaagagcctttctaaggggaacatagttacagggtaaaaaaaatcatattctcccataaaaatatcccttttgcttcttttacagccataaattccataaaaatggaaagtgatgcaatcgaacatacatgagaactgaggccagggaaggtctgtctctgtgacagccagaagaaaagccaatcggaattacatcacatgctttatatgaagtccatgtggacatcaggcacacttcatcccgtctgaaaattcttcccccacttacgtctgtgacacaaactacaccctgaaaaaaacactctgccaaggaaaacagcttctttttcactgcagatatggcccttatgtctagaaagtgatatgcttactatcatgaagtttgggttaggaggtttgtaatctatcagaggtttataagaaaatgtgttacaaattcagaataaaggaggagatctaagacagcagatcggcatctttggcaaacactggaaacagagggagcagctaatatagaaatactggaatgagtagatgaaaaatgtgctagactaggaacaaagccttatacagaaaggaaatgccattattctttccctaccagaaaaacaattatgtatttggtatgttccattctccgaggtttaatggagctcctgaaagtaattcatgctttccatggcctccaagattcagctctcacagtttgattcctctaatccttcagtgttggggtaggaattggagtttccaacagacgagagttacacatctgagatctcccagaggctcagttctcagagacaatgttcatgtgccaaaggacttgcaagatgccaggatttctaccctggctgactatgttttgtattcctgcctttgcacaagctgagttttgcaacccatcttctacctttccaaaaatgttatatcatggtttttctatgatgtcatgtttgtaaaagcaattcaggcattcactgacacttaatttaatcaaagaactttcaagagaccctaccaattccaactacctgctctggatcaaaatggaagtgcacacccttccatgtgcctatttaaaatattttctttccctccaatctacatgatttattcattttaatagtaatgcaagcagtattcccaggcttaaatgaggaatcacactcatcactcaaagtagaattgggctgggtgtggtggctcacatctgtaatcccagcactttgggaggctgaggcaggcagatcacttgagatcaggagtttgagaccagcctgaccaacatggtgaaaccccatctctaccaaaaaaatacaaaaaatagctggcatggtggtgtgcacctgtaatcccagctactcaggaggctgggtgggagaattggttgaacctgggaggtagaggctgcagtgagccgagatcgcaccactgcaccccagcctgggtgacagagtgagaccctgcctcaaaacaaacgaacaaaaaaaaccaagtaggggaattaagaaacgtaagtaattaatgataggaaacattagcaacaaatgttatagttcaatccaataagaacattctttcaatggagaaaatattaaaaactgacccttactagtactttttagctaatttttaacaataaaagaggtgtctgcatgacataagaattcatcttatttgtatttcttagaaatccatttttctcattagtcaagttaaatatagcacttattgttatgattattatttggttatacctcttcaataataatgtttatcattataagctagatttttgagccaggtactttaactacactattgcattttaatcttatttagtccatctgaaccatcctgtaaggttggtgctgtcgcccctattttatagaagaatgtgtggtcaagtgactttggtcactcctcaagtcactccctatacagctggcaaaggcaggctggagacttgctggagtctgctttcatcttcagcctgcactctttccacctcactccactactttcctcaaacattcttctgacctgaccacttctggaaccattaaaagtaactagccattaaaagttaaatctaactcaaggattgatggtctctcagacaaacgtgggctaataaaggtcatgacttgctgaagatcatataaatgttttattcacctggacagagtccatgatgaggggcagagtttacaaatttcatgacattttcagctgtagaagtggcttgaacaatctcccattgtggaataacagagtcgagggaaaagtttaagccaaaacaataatttcccccaaacttcttgagttcactcatatctgtgcctctggtcttcattttcagaatgatttgggcactgtctgcaggtcaccctagtactgtgcttgccgaacctcggcttaactctctgagagggagggactgcaagaaagaaaccagaggaaggactgcgcagggaaacttattctaaactttgaggcagtccctggttacattcaaatccactggacagtcccctcatatctccactccttgatccacgttttcagcacaatctcaacatctagttagagatggaaagttgacagaagtatgaatagttttgtgttttttccttgtgtatacatgcttgcatacacacacacacacgcacacacgttgtgatgaagtaaacactggataaatataatttcctccctataatttgcaaactcagcaaggagtatgcacatatttcacaactgataaaaatcatttacacatttttctctcctctcccactgctttctcacagaggtctgcattactctaactctgctgcatttcataaagcaacaaacaaaattaaaacctagaacaagagaacaggcatatttaagagcaagtggtagaaaaagaaaaaagaaaacaaatttttttaattggtgtacttattattttcagaagcaaaatgatttaaacagaggaacagataaaagcatctcacagtctcaaaagacctatttgggctattcgtaaatttaataattatgcatatgtaaaaataataaatattcaggtgcttggtccatttaaagccacaaatttatttttgaaaaaatacaatccaaaatctttaaaactgacaataacaatataaactaatagagcaggttactctagaatattttataaagattcctagcaatagataacaataataacatgaataccactgtcaacaacaatgcctgccattcaatggatacttaatcagacaagggactaagggctttaaatgaataatctcctggaatcatcagaccaacccaatgacgtaggtatttttcttatccctatttcacggataaagaaactgaggcttagggaagttgaataatttaactaaagagcagcattgggactcaaaactatttatgtcttaaacactatgctaaaaccaaaatagcttaataactttttttttttgagatgtagtcttgctctgtcacccaggctggagtgcagtggtaccatcttggctcactgcaacctctacctcccaggttcaagtgattctcctgcctcagcctcctgagtagctgggattacaggtgcatgtcaccatgcctggctaatttttgtgcttttttgtagagacagggtttcaccacgttagccaggccggtctcgaactcctgacctcagctgatctgcctgcctcagcctcccaacctaataacatttaaatgagttaaactggcttgtaatcacaaatattttgagacaatcaccttctaggagaggcaagaaatttgacaacgatagcaacttcaaaaaaaatagcaaacttacatgatggtggaaatttggaagagagtggactataaatatgttaattcccaaggaagaggaataccaaaggaactcctaattaaagcctgaacctctcagtaaggaaaattccatcaaaggttttccctgattgttttttggaatctatatgtctgaactaaaaatcttccgcattctactttgttgtccatatattaaataatatcacataaagcatattatatggagtatttggaaaaagtatgtatgtaaactgtaactttctagtcacattaagaacataaaagtttataaccctggaccgtaccttggtcttcataaacttggagtgacttttgtaaacctcaatttgtttgatctcttcttcgcggtcctcagtgttcagcacaccattggcttttaacatctggatctcatcctcaagatcccttatgtttcgttccaatgaagcgatttttgtgtcctgttggtaaagaagaaaagaaaaagaaaaataaagaataaaaattatttttaagatcatcaaaacagaatttaagaaagtaattttggtagtgctgtcacatattaaccatggtatagacagccctgaatttaggacaacttattttttttcacagctgagggtcatttgtgagatgatagtttaagctcccaatcaagaccatgtgtcaatacaatacagagaattatctagatatgtttatctaatatctgggaatcaaattaccaaagcaacagtgataaaagtaatctaagtgttaaaaaacaaaacagaacaccatttaagtggacagattttaatctgggatatagtttacctgtgtatatttttgaatctacttataaacacaaaaacagtttatgtgtatattttatggctggttttataaggcatgtttggaatttgactctgagagagaaagaaattcaaatctactaatgggaaaaaggattctcatctaaaatacagacgtaagtgaaactaaataactgaatcttgacttggtatgactgatacactaaatattgaaaatttatagtgattggaaataatacatcacaatgtcataatttatttggcgagcagtcaggtccctacgtaacaaaaaacatgactaccttgcagggcagttcaacctattgatttatggagccaacaactagaaatattacactcagatgtggaattaattgggaaaaaattaccaatgacagactctatacacaaggtagagcattagaaacaatgcattagaaagtagagaagagagagctcttatagggtaaccaaaacaaaacaaaaaaaatgacgaaaaatttttccacaacagtaagtattaggcttcaatcggtctttgaaatgaaagtttgacacatcgaaaactgacttcaagttttctcagtgtcccatctgcctgccattttactgcacagagttaaggagctcatattaaatgtataactgaatgctaatacagaacaatctatcaacttttttaaccaattcattttctcagaatcaaaaagactaagaactccaaaagtaaagacaatgaataggctattctatttataagtaactcatttttaaaaaccttgcaacaaatgtgtctgtcctgattttgtggctattgtctactttattttcctataatctatgcccagtggtatatctcctatggcaatatagtaattatcattgttattatcattaacattgtcatcatgttaaaaggaggaaaagaaggagcagtaaatttatgcaactctattatgtaccaagaactgagtgctctaagttctgtagatacttttattaattctcagaaaaacttcaagaagatgaaataaaaagattttgaaaattccaagattattaggaaatggaacattctgtagtatttcattttcctttaaaaataatacctattgtattttttcagttataaaagcaatatactttgaattcatagaaaatggagaaaacctctaatcctactgtctagaaataaccaccattaatgttttcatgtatattctgccagtatttttctatttagatgccatttctggaaatattgtatactaccagtttaaattctgaaaagtgttatggactgaatgttgagttccccagaaatatatatgttgaagctctaaccctcaatgtgatggtatttggagatggggcctttggtgggtaattaggattagatgaggctaggagagtagggccctcagaatgggattagagcccttataagaagagacaccaggaagctgctcactctcgctctctctaccaagaaaggacatggggagaaggcagctatctataagccaggaagagagccctcaccagaaccttatcatgctggcaccctaatctcggccttctagcctccagaactgtgagaaaaacaaatctccattattgaagtcacccagtctatagtactttgctaagtcagacaagctcacaaacataggttcaagcaattttcatgcctcagcctcccgagtagctgggattaccagcctgcgccaccaagtacaactaattcttgtatttttagtagtgacggggtttcaccatgttggccaggctactctcgaactcctgacctcaagtgatccacccacctcagcctcccaaagtgttgggattaaaagtgtgaaccattgtgcccagccaatatttctgttcttatataacaagtcagtttcaagggcaaaagagctcatatctcacatcatgagcacagggaaaagtaggtaggagaatatcattaggattcaaaggaaaactgacacaaaaaatacagatatatcagatggttttgggttgtgcccaagaagatattcaaaacgccaaaccagagaaggacagagggaatataagcatgaaaataaaaagcaagtaaaatggctggcatgtctaccgcttttcaactgcatcagtccaaagaatttagagggaaggaattttatcattttcttttttaaaaatcgctaacactaagatacatgactaaaacctaatctatgtaaggagtactatggaagtccatatcaagtcctgatgtggctgaatgtgacatacggatgttgagatgctaaatgcacatggctcagaaactcgacgcgctaatctggaatagagaaaaaaaatacatatatgaagacatatgttgtaacttccagaaaagtggagtttcagaaagtaaagcaacattttacgccctaatcgccaaagagctttcttcatctgaacatttttacaagttatttatgactgatattttaaaacaatatatgtagtgattttcaaacacatatcttgattatatttcacaaataaacaagctctggaagcagataatcgtgggccttccttagagacggggaaagtgaaatataatgtagagtagcttttcccaaagttcacagaacccaaatgctccatgaaaaggggattgcagggtcaagtatgtttgagaaatgcttgttaggaattttcaatgcgcattaacataaatggctctggaaagtcctgaagcaaaatattctatttaattttatttatcacagtattactgcctctagaagtcaattcctgaaaaaaaatttaggcttgtaatgatcacattaagctctgggtaatattactaaattgaagagtcaaaacaacaatttggattcttcaagggaaaacttgccacaatcatccccaatttaaaatgaaggggggggggcgctaaatatctagatcagcctgccagcttctgtcactcaaaagtggtttactgagctcctgttctaagcccagcacttaagacaacatcagtgaaagaacagacatggacccccatactcctggaacttagcacctcacgtctcaggcaatagttttcaaacagtctcgagatagggcaaccatgaaattgttttgtctttatattatattttggttatggattgtaaagatgtagaaaaaaattttcagggaaaaaataaacatctaaacaatgtttgcttcagttaggaaaaaagatctcaattgagtgtctcttttcaatcatttctttctacacattcataaaataatacttataaaaatttgatgcataaattgcagatcatagcttctaattaaagattcatacccaagactattttacatctaccatctcaaaaaatgcaaaataggtatttgatgggcaactaataaataaaacactggaattgaaccccagaagccatttacccactaggcccaccgcactaatgtctaagccagccttaaatactagcactagcccatgacggctatagttatagaaatgaggatgaaagtgggatgggaagattgaaataagtttatttcttccttttctctctctttttttaaatctatctctagatttctctagaacatgtgtgctatagattaatagtaaacttagacaaggagttctctcattcattcattaattcaacaaatacatagggcacctattgggaaccagtcactttgccaggtgagtaagataccaggtagatctcaagaagatccatgggcatccttccctctctaacatgaaggacagcctggatccatgctactcaaagtgtggtcacagatcagcggcactgacatcacctgggagctttttccacttgcaaaatctcaggccccaactcagaactattgaatccaaatccatattttcacaagatcctcgggtgattcgggtgttctaaatgactgtacatgtccagaagacacaagggccaagactgaccaatgcagaagacactagggtaactctattttccaaatacatttagaaaaacatgaatctagtttcaagagccatccaacttaacattaagtgtacagcaaccctgggagtaaattttctggagtatctttgctagtcaggatgccattagtactctttttgtgttttcaaacagtatgttccccttaaacagcaagaaacagatttcaatccctctccaggaactgtgaatactgaaatggtgagtgggtggaacatcaaaaagaagcaatatcatttagtcacaaaaagtaacaattatattattgctgagtgtcacaatgtgctttccttttaaataccgtgagaattactggtttcattttaatatcaggccaagaaagaagacataagcagtttttacagagcattgaattcactgtgatcacatattggtctacggacattgatcaacaaacttagggccaatatggtttttaaaagatgtgatctaatgttcaggaaacatacctacataattatattacactttatttagaataaaatttgaaactgttattactggataccacagaggctcttaacagcttaactttaaaaaatcatctagtcatagctgcaaacacaactgagcagccctggatcttaggctacctgagtaaggccctgccttgggaaggatttactgtgtgggatgaccgtggttatatgagcccaagttagacactccagaaagaagttgacttaggcctaagacatattagtaaaaagaacgaataccaaaaaaatcaaaaactcgccttcttgggccttgtcaaactataaaaggtgatgacctagattagaaaatgacatgagaattagatggtatctaattctttatggcaaaatgtacaagcacagaaaaggttggactagatcaaatgaaaagcaactagggtgctttgatgtttcttttcctggtcttatttgcctgcttctgactcattcttcatgaaacccatgcccttggaacacatccttcctgtcatcctgtctctgtgcatattactaaggactcatgagcagatgtgtctctagtggttcttgcttgacactgtgtgatctttgaagttatgatctccatatattaatttgttcttgttgttaatggactcagctctaagaaaaagagctaaatctaaagcaatccagacagaccgcacatgaagataaaacatctgacctttacagagtcacaaacctggatgcaaatcctagttcaggcttttacaataagactatgctcctgagtatgttaagaaaattacaagtgaggtataatgcatacaaagtgcctatcacagagcctaccctaagagagtgaaaagttgtcattattatcataagccaaaaacaatgtagtaagtccctactaattccccagttgttacttacacaattagaagacagcttccatttttatttcatcctgttaaactttctgagcatgttcctaaccttgctaatcctataacctaagtttactacaagaattaaatgagtggctacatggaagtttccagaataacagctaaaacacagtagtgctcaataaatgttagcgtccctcttgtttccagctatcgcacatatctattacttttttggtctgcccagcttcctttccttttgggaactgcatcttcgcaacatccccatggttttaatagagttttaaattgtgtggccctgcccagagacaggtaccatgggtcttctgaacacaatgattgattcaggggtaaacttttaactctaggaaggccaatcagagttcttttaggggactaacattaatccagaagagaaaagatctctctcttattttctgagtaaggaaaatgaaaaaaaaaaaaaaaagaaaataaccgcatgactggatgtggccttctttgatatcatgtattgagaacctatctgaatgattgggcccttataacatcatttgaacagctatatatagctacatttgaaccatccactctccagaataccaaatatgagagtaagttttctgttacctataacagaaaaaatataatgcacaagtgatagcgtgaaaggtaatgccaaaatatgtaatgttctataagtctatatatagagaagtcaggaatgggtaagattgccatagcagagtcaagaaatctccagaaggcacaggagcctaacgtggggtttggagatgaataaaaataatattatcacagagaagatgaaattctttccagttagaagtaataatacatacaaaatcaagagcactcagcatgtgcccaggatataatatttaataaatgtaagtttaaagaaaaacagaatgaatacagagcatgtatgtatcaaggaagagtagaatacagaattgttcaaataatatagatcatgtttagctgctgaggagttggaaatgaaaggaaggtgctgcagaatgataatcagtcttcagaatcaagctaggaatttgtactaggttctgaaagcgagtcatatactggtaaataagaaggcaacaagatagtctttgggcagttagtaataaaaccagatgccgaaatgaaatttgaaaactgtggagacgacaaaaccatcacttagtggtgaaagaattctcagacatagttgagaatcaaggatagagaaaagggtagaagaatcaccaaaagaaagaggggcaaaaatcatggaaattatggaaaagtcctagaaaatgagtgaatagttttaagaaggaagaggagtcaaaggtttgaagagcctaaagactaagaaaaaagttaagatggcattggtgacatgagggtagtttcatcggagttgtgttgccataattggaaactgaaccccagtgttttaaatcccatggagccaggagtgattcccgagtcactcaacaaccagtatggaacagactcagatccccacaagacggacacctcctgaagcactggaaccaggtctgggaagtcactgcagggccaaggattaactctttagtagctgaatttggggacccctaggtaaggggtggagttgggtgcagggtactctgagggtttggggtagctgtagaagtgttgcaatattttagcaaccaatgtagctgtacctgtgcctctcatctgagtattggccctgcaaagaaaactgcttcagttaatgtcaagagctttctacatccctagtgcatggaagggagcactggctgattaaaaatcatttccatgtgcctgtaacacacactaaagcaaaggttccctaatgccaacctgaacactaactgcatcaaaatcatctagagagtgagcaaaaaactactgatgacttagtttcacccaaggacattctcttttggaggattggggaacacaaaaatccatatttatttgtaagctcctcagcttgggggtaagaaaacaaacaacaacaaaaaaacaatagctgctatgtattgattacctacacaagcactgtgctaggaaattctcatttaatattccccataatcctatgaattaaggatttattttacccatttaacaggtcagaagacttacagatggtaaataacttgcccaaggtttccccctgggtaaactggaatcgttccctcaatagataggcctgccttgaatagaagacaggaggccacatattgggaccttgctgtccacaggccaacctcagaagggactggcttcagagaatgtatgctattctggttctttcttccacagtaattttagcctctaaagatcaccgagcaaggtcaaaagaaaaaagtaaagaggctggggagagaggaaagggaggaaaaaattttcagcaactgcttccagatgagtgggcagtccctccatgtgtgcagggccatcccctcaacaatgggttgcatgtcatctttcatgtacatctaaatggaaagagggtttgaattccagctgcccatcctgagaatgccagcaattcagggaatactactttgcaacacagtgaatgcattttagggagcctaaaaagatggacatctgaccactccatttctcttccagtgttctttaggaaaagattgagtgaggaagctctctctccttgttagccttctagcaagctgaacttgctcttcccgttccttttaacccacttcctggttgggtttggtgtctcctcttagaatctccgaaacataccacagatcattctacattcaaccagtttgtctcatggaaaaaaaaaaaaaagcaacaggcagcagtggaattcaggccaccccaagtcaccaatgtggcctgatggatgtggaaactggaccatgcctcagggatgaggcatgtgatggttggtatgctgtcattactgaaacctgaaaggggaagttcacatgaggcctgtggttgacttctcaaccctgctggcaggggcacacgccagtaaggaaattgcaatccctaaataaacggtaggctgggaacctgagcaccagcaagggagagggcagggactgctggcctgggcagggctggccaagatggagcaaacaaagctaagatttaaactttgcaagaatgtcatgtcaattcagactccccaggagggccccctgagagtccaaattgccagtcatcaagcctcagacttggcagaatttttaaagtaggacagttagtccaatcccttcatttgtcagataagaagagtgagagccagtggggacaagtgacttgccaaatgcccaatagccagaaagctaagttcctaggtcatttattatcccatagacctcctgagacttgctattttttctccactgttttctcctttcaaagacacttttaaagtcttttcaacatgcaaactatgtgtgtattcagagctaagactctctctgcctaaaataggcttatttagttccttctctctggtggtccttgctcaaaggcacaacctcttttttacagataaaactcaattttcaaactcaaagggaagagatggagaggcaaaggattccttgatcctctattatgtgccaggattttcccatgccttaactcattttaatccccaccacaacccgtacaggctagtatcatggacccatttcccagatgggaaagctgaagcatagagaagcagtaagcagcaagcaaaattctcaatttccataaataacctaaccttctcctctttggaaccttctcagttcagaaaaacaaaaaaaaaaccaagaatttaaaaaatagggcattttcaagatttctgattatggcttttcttttaacaaacttgttttttttcaaaataataattcctgatcatttctatgtttagaaaaaagcacattattgaaaacatgaaaatttaggggagtgatatggtttggatccgtgtccccacccaaatctcatgttcaattgtaatccccaatgttggaggtggggcctgcaaggaggtgactggatcatggaggcagtttctcatgaatggtttagcaccatatgctggatgctgtcctcacaatagtgagtgaattctcatgagatcgagtcatttaaaagtgtgtggcacccccccaccccacctgttttgtgcttttactctggccatctgactgtgactcctccctcttcaacttccaccataattgtaagtttcctgaggcctcctcagaagccaagcaaatgccagcatcatgcttcctctacagcctgcaaaactgtgagccaattaaaccttttttctttataaattagccagtctttggtatttcattatagaaatgtgagaatggaataatatgggaggaaagaagaggaaaaaaatcctttataatctctcttcccagaacaaatgtcaacattttagtacattttccccgaagttgttattctacattgataaatataacctttttacacattaagaatactaaacctctaaactactataaactttaaaaatacatttcatagttggttattttgcgctttttatcaacttttattttagatttagggagtatatgtacaggtttgttactcgggtatactgcaagatgctgaggtttggggtataaatgatcccataacccaggcattaagcatagtactcaatagttattcaacctttgtccccttgcctccttcctccctagtagtccccagtttctattgttgccatctttatgtccatgagtacttgatgtttaactcccacttataagtgagaacgtgcagtatttggttttctgttaatgtgttaattcacttaggataatggcctccagctgcatccatgttgctgcaaaggacatggtttcattcttttttatggctgtatatagtatcccatggcgtatacatactaagcgttcttcatctagtacaccattaatgggcacctaggttgattgcatgtctttgctatggtgaatactgttgcgatgaacatttaagtgtatgtgtctttttggtaaaacaatttacattcctttgggtaatgggattgctgggtcaaatagtagttatcttttaaattctttgagaaatctccaaactgctttccacagaggctgacctaatttgtattaccaccaacagtgtataagcgtttccatttctccacaacctcactagcatctgttgtgctttgactttttaataatagccatcctgattggtgtaagatggcttctcactgtggtttttatttgcttctctctgatgattatgtttgttggacacttgcatgtcttctttcgagaagtgtctgttcatgtcttttgcctaatttttcatggagttatttgtttttctgcttgttcaatgtttaagttcctgatagattctggatattagatctttgctggatgtgcagtttgcaaatattttctcccattctgtagattgtttgtttcctctgttaatagtttcttcagctaagcagaagaactgtagtttaattaggtcccacttgtcaatttttggttttgttgcaattgattctgaggacttagtcataaatcctttcacaaggccaatgtccagcatggtgtttcctagattttcttctgggattcttagagtttgaggtcttacatttaaatatttaatccatcttgaattaagctttatacatatagtgaaatgtaagtgtctagtttcattcttctgcatatggctagccagttatcccagcaccatttattaaataggaagttgtttccccattatttacctttgtcaatttttcaaagatcagatggcaatagatgtgtgtatttatttctgggttctctattctattccactggtctatgtgtctgtttttataccaatactatgctgttttgtttattgtagccttatagcatagtttgacatcgggtaatatgatgcctccaggcttgttctttttgcttaggattgcttatatggtttggatgtttgctccaaatcttatgttgaaatacgattcccaatgttggaggtggggcctggtgggcggtaattggatcatgggaatggatccttcatgaatggtttaacaccatccccttgctgctaagtgaattcttgctcagttagctcacatgagatctggttgttgaaaaagagtcggggccctcctcccagttcttgctccagcttttcatgtgatgtacctgctcctgctttgccttctgctgtgactgtaagcttcctgaggccctcacaagaagctgagcagttgttgttgccatgcttgtacagcctgccaaaccatgagccaattaaacttcttttctttatggaatacccagcctcaggtattactttatagcaatgtgaggacagcctattacaattgctttggctattcaagttcttttttggttccatatgaagtttagaaaagttttttctagttctgagaaaactgacattggtagtttgataggaatagcattgaatctgcaaattgctttaggcagtatggccattttaataatgatttgtccactctatgagcatggaatgttttttccatttgtttatgtcatctgtgatttctttgagcagtgttttgcagttcttctcatagagatctttcacctccttggttagatgtattcctaggtattttgtgtgtgtgtgtggctattataaatgagactgcattcttgattttgctctcagcttgaacactattggtgtatagaaatgttactgattttattacattgattttgtatcctgaaactttactgaaggtttcagaagtcttttggcagtcgttagggttttctaggtatagaatcataccgtcagtgaagagatatagcttgacttcttttcctgtttagttgccttttatttctttctcttgcctaattgctctggctagcacttccagtactatgttgaatacgagtaatgagagtgagcatccttgtcttgtttcagttctcaaggggaatgtgtccactttttgcccattcaatgtgatgttggccatgggtttgtcatagatggctcttattattttgaggtatgttgcttcaatgcctaatttcttgagggtttttatcatgaagggatgttggattttatcaaaagctttttccacatctattgagattatcatatggtttttgtttttaattctgtttatgtgttgaacacatttattgatttgcatatattgaaccaactttgcattctaaaaatgaagcctacttgattgtggtgagttaattgtttgatgttgttgaatttggcttgatagtattttgttgaggatttttgcatctacattcatcagggatactgccctgtagttttcttttcttgtgtctttgccaggttttggtatcagggtgatactgacgttgtagaatgagttagggaggagtccgtgttccttgcctttttgctatagttccagtaaaactagtaccagctcttctttgtatgtttgaaagaattcaactgtgaacccatccagttcaaggctttttttggttggtaggttttttgttacttattcaattttagaactcaatattcgtcttttccgtgtttctaagtcttcctcattgaatcttgggagagtgtgtgtttccacgaatttacccagttcctctagattttctagtttgtgtgcatttaagtgttcataatagtctctgaggatcttctgtaattctgtgggataagttgtattgtcacctttgtcatttctgattgaatttatttggatctttttttctttgttaatctagctaatggtctatcaatctgtctgttcaaagaaccaatttttagtttcattgattctttgtatgcatttttgggtctcaattgtgttcagttctgctctgttttttttatttcttttctctgctagctttggggtaagtttgctcttgtttttctagtttttctaggtgtgatgttagattgttaatttgagatccttctaactttttgagataggcacttagcactacaaactttcctcttaacactgcttttgctctgtcccagagcttttggtatcttgtgtctctgttttcatgtagttcaaataatttttatagttctgccttaatttcactgtttactcaaaagtcatgcaggagcaaattgtttaatttccatgtaattatgtgcttttgagagatcttcttggtattgatttctatttttattccacagtgatccaagagtatggttactatgatttcaatttttctgaatttattgagactcaccttatggccgagcatgtggttgatcttggagtatgttccacgtgcaggtgggaagaacatatattctgtggttgatgagtggaatattctgtagatgtctattaggtccaattggtcaagtgttgtgtttaagtccagaatttctttgttagttttctgtctcgatgatctgtctaatgctcacagtggggttttgaagtctcccactattattgtgtgttgctgtcgaagtcttttcgtaagtcttacaaattcatatttttgactctgagtgctccagtgttgggtacatacatttttaggttagaaaagtctttatcctttatcattatgtaatgcctttctttgtcctttttaactgttgttggttttaaaagtctgttttatccaacataagaatagtgacccctgctccttttttgtttgtttgctttttatttgcacagtggatctttctccaactctacttggagcctatgtgtgttgttacatgtgatgtgggtctcttgaagacagcagacagataaatcttgtcttttgatccaacttttcactctgtgccttttaagtggggcatttagactatttacattcaagattaatattgatatttgaggttttgatcctataatgaagttgctagctggttgctttgtagttttgattgtgtggttcctttatagggtctatgggctaagtactaagtgtgtttttgtggcagcaggtatcattcttttgtatccatatttagaatgcccttaagaatctcttgtaagccttaagtaagcaaagttattaatcatttcctttataatatttttctttatttttaataacagctttcatgagctataatacacacaccataaaattcacccttttaaagagtataatttagaggtttctgcaaccatcactgctatttaattccagaacattttcatcacccaaaatccagtacacattagcagtaactcttctttcctccttccccctagctcctggcaatcactaatctactttctgtccctaatttgcctacactggacatttaattaatagtatcatataatatgtggccttttctgactgacttcttccatttagcataatgttttcaaggttcatccatgttgtagcctatatcagtaatttattactttttgttgatgaataatattctactatgtggatatgccatattttgtttcttcatatatcagatgatagacatttgggttgttttagcttttgctattataaataatggtagcgtgaacacttgtggatagtgttttgtgcggacatatgtttgcaattctgttgggtgtgtacctacaagtgaaatttctaggtcatgtggtaactctatgtttaacattttgaggaactgctaacagttttccaaagagggctgtaccattttatgttcccaccatcaacatatgagaattctaattattcacatcctccccaacgctcattattgtctgtctttcttattttagccatcctagtgtgggagaagttgtatttaatgctggttttgattggcatttccctaatgacgaatgatgttcagtattttttatgtccttattggccatttgtatgtcttctttggagaaatgtctaattaaatcttttgcccagttttgtaattcagttatctttttattgatgaattattttttctttatttttaaagaaacgttttaattaaagtattaatataagaaagtacacaaatcatagactttcaaaatgatgaattgtggtcaagtgaacacacttgggccaaccagatcacaaaacagaacataatagaaatagaatattacctgtacttcagaaacctccttcctggccctcccaaccttcacttttccctcctcttcttcaaattaactactatacagatatctaatactatcaattagtttagcttgtttggagaacatatattatatatgttcttttgtggctggcttcttccaacattattttggggatagtattcatttacgctattgcatatggcaatagctttttttttattattatactttaagttttagggtacatgtgcacagtgtacacgttagttacatatgtatacatgtgccatgctggtgtgctgcacctattaactcgtcatctagcattaggtatatctcctaatgctatccctcccccctcccccctgcatatggcaatagcttggtccttctcattgccatatagcatttcattgtatgaatattccactactgttttatccaccctactgctgacagctgtttcacttgtttaaagtttttagttattctacatttagttatgtgttatacctttttatttaaattaggtcttttatagctattgttagacttgctcttatatatttggggttttttaataccagtgtaagtgatattgttttctcaatttcatatcttaattgtttataactagtatgtacaaataagattcattttaaaatactggccagccatttggctaaatttatttactaatctaatattgtatatatggattcactgatattttctacagactcgattatggtacttgtgaacaaaaatgttttttttttctttctaatttttatacctaggatgtccatagcattatcgaacagaagtgatggtaactggcattcttgtcttattccttatatcatagagaaagctttcaacattttaccattgaacatgatattagctatagctttcttgtaactattcttattagattaagaaaatcctctacttctgagtttctgaaaaacatttttgggggccatggatggatgttgcattaatcaaatgctttttctgtacctatgaattatattcattttctcctttatcctcttaatatggtggataacatgattgatagccaaatatcagtccaactttgcattcctaaaataaacacaacttggtcatgtcatttatttgtcattgagttcaattcactaggatattttctaccatcagtgtttactcaggagattgcttgtaattttccttttttgtaatatatttgctgggtatgaatatcaaacatatgctggcctcataaaacaagatgggaaatgctccctctttttctattctagaagagtttctgtatgattgatttcatttcctcttcaaacatttggtacaattcactcaaaaaagccatctgggcctctaattgtttctgtttggtttgggtttttaggtttttggtttggtggtaagattttaatttatagaatcatttcctttaacatataagactactcagatattctatttcttcttaagcaagttttgacaaattgtgtttttaaaaagaattttttcatttatctaaaatttcaactttattatcacaaagttgctaataaaatcctctcatattttaatgttaataaggtttatagtgatgccccactttcatccctgatattggttatttttgctgtctctactcttcttgctgattctaaccaggatttgtcatttttgtgaatctcttcaaaaaaacagcatttagttttggtgctccactctagtatatgtttaccctctatttatttaatgttagcttttatgtttattatttctttctctccaccttctttttctactggtttaatgcgatctaccacaccttttaaatttacaatgtcttctctcaatcaaactgaatgatttgctctgccaaagacactccttatcctttctagactcgtggctcttatagttcccactgtttataaaccatattcccctttaccaaaatcatgccagttttccaaggctttctccaaatgctaccttctccaaaaagcattctgtcttcttctcttatttgatatcctttgactcctcatagctcatttgcccttcttaagtcactttataacctggtttatgtacttcattccattagctccttaaagacttagaactcagtttttcctgaaagcctcatcatggtgctgtacacaaaatagttgctcagtaaacactggtgtttattatgcaacttcaggagttagattcacaaaaactaacctgggtaatagcaggaattattgactggcaacatttagtcaaacatgtagagtcaaatatatcataagaagagtttggggggaaagggaaataattctcatcttctaaaaaaaaatcttacttgcttctaagtgacaaccatatatcatctagaactaacatttgacttgaccatcacttaaaaatcacattttgcccattatttaaggcaaatagttaaatgggataaaggggtttgttgttgctttatattggggggtccagttggaaaatgagaagatagagaaatttcccaagaaaaaaaagtaagctaaaggataattctaatattgtaaatgcacactgcacatcaaaacacacagtcctttacaagtttgaacaagttatcacaccaggctgttaaaaaaagacttcagagcaagacttaaaatgcagggggagaaacagggcatatgttggctgtaatgtacatatttggagccctatttggagccatgataacacatgcatgtaaaaaggatgagttttgccttttagcacaaaatacagctctgcacctttccaaaaatatcacataagccactccatctctcatgagctgcctctacccattctaggatgcaaacctcaatgcacaatttccaaagtaaatgttgaaagaaaaaacgtttgaacctttgggctatctttagaaaaggcagaaagaaggagtaaagagtgcaagagctttgaggagaaacttatgttcaaatctcagctgccaatctgactagctgcaggaccatgggcaggttgcttatcctctctaacccgtagctttctcatctgtgaattggggataactctgcctattcacaggtttattgcacatcaagtgctgtagcccttatgtgtggtagtgatgttgctgtcattgggtattactgggggtgcaggtgacatcgttgttgttagtgctgttattgtttttaatagccacaaaaggagcaggggcatattcttaaggcctaaaagccatcatcataattgctttactagaaaaactgggattggcacaaatttcatatgaacacagcatccttggagaagatgaatgaaataaacctaggtaggccctacagtcaaagaagtggcagctacttcatagtgtctctgaccagattccaggactcagacaagttcataatgggtattgggttgtgctgagtagtctaggtttgcctttgaactctctcccctttccagttatatgaaacttggtaaagttgcgaagtagtagttcttgacttcacagtgttccagtacatccctttcatattctgtggaactaaacaggctaaatttgaccaaataccaagataccttttaagtgaaacttaacccagctgcaggtcagctccatgcagaacaacagttatctgcctgggcacaaagacaaagtgaagtcttatttttataacaaaaaattaacctctgcattaaagttgcacctgaatgcaaaatcatatactttcaccaatagtaccacttatacttcagcaacttagtggagctcagtcttgctttgcttactacttatttccaattaaaaaaaaagcctggtggggacaaatgtcactcaagaggaacaactcaaggcacacaagtgccctcgctgaccgtgggactggaaagctaaatacccacaatccccacttcaattaccacagaaatactgcttttaacttcacattatgcctctggcttcttaatccactttagttaacaagttcaccaaatcaccaaacttttactaaaacccttactaaaaaccttttactagttaacaagttcaccaaacttttactaaaacccttatgtcactcatatatgtcttctttgataaattctgctgaaaacctgatagtttctgctatactagcaaaatgtttgtttttcccaaagaatatcatttaatgttttaagcaaatgaactctagaaaactctatgtattttcttttcagcttcagctgctaagtttggagtgaagctttatgtgtcatctcagtaattattattactctaagggttgtgtttttacattttttaaaaaacacaacattctccctgcccttccatttgtgatagttggagttgctgtagccatttgctcacaggcagggagaggttgcctgaaaatagagctcacatgaaggaagacaagataagggatggaatgagagaaaatgggatctgctaatatcttttgagcctctggatcaagctgtgcctgaagcaatacccctgtttttttccagtaaatttttttccaataaatttccttttgacttcagccactttgaaatagattttccttcacttaaaatttctagctaacaatgaaaaagggggttgagattatttgacaagaactaccattactgtcattcattttcttaaaaaaaaaaaaaaacaaatggctttatgaatgacccaagaaagtaaaacttttggacatcatgtttatgtcatgtcaaatttataataaaaataagttacacattctttcaaagaaattagcattaaagaaagaaaaaagagaaaacaagcctttcaactgtcattcttattgacagttatccacaagagcagaaaagaggagcttagcaaagaatctttagacacaaaagcaagagaaagaggagcactgcaatatctacaagaaactaattttccaagaaacacacacagtgttctaagtgcaaacttggaacatacctgccagaccaaatcaggatcaaaattaaaacttgaagcttcctgcaagaagataaatcacaaataactttattcactttgcttcctttcatttttcattaggtaacttcagcccccaggctcaactggctgcagtggatgtaatgtctgcaaaagaactgcccccagtttgatgcaggcagatgatatttcccaaggttcaccccagaaaaacatattttcacaactccaaagtccagagggggtacacaaaaatctagaaccagactgtggatctaaatagtgcttgaatttaggcaagatttcacagactttcacaacaaatgtcttttgcgagtttatgcaaagtgtgtatatggggacaatgggggttgaagctcacccttagttcctctaaaaagcaagaaacaaatagggataatctctgagtccaatttagtctaagaaatctcttctgtttttttttttttttttttttttttttttgaggtagtgtctcactatgtcacccaggctggagtgcagtggcgagatcttggctcactgcaacctccacgcccagggttcaagtgattctcctgcctctgcctcctgagtagctgggattacagctgcccgccaccacacctggctaatttttttttttttttttctgagacagagtctcgctctgtcctccaggctagagtgtggtggcacgatctcgactcactgcaagctccgcctcctgggttcaccccattgtcctgcctcagcctcccgagtagctgggactacaggcgcgtgccaccacgcccagctaattttttgtattttttagtagagacggggtttcaccgtgttagtcaggatggtctcatctcctgacctcatgatccgcctgcctcggcctcccaaagggctgggattacaggcttgagccaatgcacctggccaagaaatctcttcttaattttaaattctatcaaggcactagatgacattgatgtttacccagggctaaaatacaacagggtctcaagttccactcactaggcttaagggtcagttcgatttggtagtcaactctaaagcctgtacaatatgagcttccaatattcccaccaatttcacaggggtgtaatgtacaaaatcagatgagatcacagcctccagcctgagctatacacatggctgggatgaccctccaccagctgcctccctaactcaatttaggtatgttgaggatagatgttaatgggacccagacttctctgttgacaagacagaaggcagtgcttttgtaagttaataggcatccaaaaagacaacagaaaaacttgaggatccgtttccgtttcctgaaaattatattgctcttcatttgtcctaaaaatacaaatgcctcatgcctacaaattagcaacactggcatccatgaaaggagaactctaggctcaatttagtgataataagtagaaatgaatttgccctagaattcaagtttctctgccttcccatgtagatgacctaagtgagttttttatttataaatttttttataataaaacataatgctaaaaacaacaaactaggatcaaacagatttttctactttaaaaagtcacaaaaaaaggtaccaattatctttgtatggagacatttaccaggaaactacccaccacattagaagagatgtttctcctgttttttccaaaggccttggaaactcgctcttttttttttttttcttaaatgataatttggaaatagattgtatatacattctcttctccattactatttgtgctgactgggaaggtgggtgtggaggtggatggaagggggactgagtcaccctttgcaaaaacaaaaaacaaaaaaaaaaacaagtcttttgtccttttgtcttttcatttttcctctttttttttttttaaagccttaaccaagtatcaggtttgattccaatgtgaagtgaggataaactctgaattatgaaccactggcctaccattccccagtgtagaatgttcagtttcttttcaaaatgtttaaattatataagtttaaaacaactgatgagccagggttaataattattgtttaatcctattggcatttggtcccttcaaagatatttttcaaacccatatgctacacatacattatgagtgccttgactcatgtaacctcatttgggggacacatagttttaaagcaaatgacctatattattttcacaaaaatccacttggattaagaaattgtcattgaataagaaaaacaatccctactcagattgcacatgccaagaattcaagagctcgtattagtttcttttccctcaaaatttgggaatttgggggcagataattcaaaatcatatgctgcaagaaggattgagaagatgcattatcctatcagcaagctttagaattctcttgcaggcccacggtgaccagcaaactccctgagttttacacttgagcgtggaattttcagattgcaaacatcttgattataaacttgtttcttaatggaacacattaaatcaagaattatttattattgagataaatactttactatttgcatccttctggcaaaaactgtaaataaaaagattttaaatttctagatactagcaaagaaatggagtttcatttagaccagtttcttaatcatggatcatggcttggtcatgctcatttacttcatgattccttaaacgccctaaattctctcagaaggatttttctattcctttaaatagtgtatctctatgcctgcacagctaaataggatactttgcaagtacttagtaaagtgttattacttccaaacttggttaggagaaaatactggggtcaccagaaagtatcattttttgaaaagtaaattttgctgatagcattattttaattattaacaataccactgcatgtaaaataacttccctttgccaactcttaatttctcaaaggtgctttttattgtgatgtgaataggaggaaaagaattattgtagtttaaaaattttacttttaaaacacacataaaacctccctaggattagacatgctttgaaaaggaacccagctcctttcagccaatggattctcgagccctttattcttttgcccagaaaaggcatcctaattaaaggaccaatacattaaatgtgcccaggaaggtaaaaaaaatccagaagtaaagcatccagcagggtgcctagagaaaaacacaaggttcatttcatgtttatattaggcaccaccaagttagaacaaactcccaaggcataactgtttctgacaaaagtgcacagttcctaccttcatttcgatgacagtctggagagccttcgtcttggctggctccggctgaagttggcttcttcggtgcaattcctggggaggaacacgatagaaataagcctgacggttcatccttccgttacaccacaacctttacacaggtactacacagcctgctgggtcctggttccccttgcacagacataaacaagccacaggtgtctcttcccccacactctttagcatccctcctgcctggagcctgcgttccggtgaaaagctcctggcacatgcgctatttctgaaacttccatcaataattaatgtcaactgtgacaaagccagcaagtaatcatagtccaaatactgttcaacactggggctgatgcccagccatcaaatcataatttactaaattacattactctgtgctcccaatacaaacacagcaaggaaacagaggaaagaaaatgactaacgtggttgcaaatccgctgcacgcatggcattttgctaccgaggcaggtttgaaatgagcagtttaaaaccatttcagtacaactgtgtcacttttgagagtgatctgatgaaaccctgtgaatctcttgcttccgaatttacagtttcagtccttgtttaaaatcacatctgtgggtgatatatttatgtatcatgatgccaagaaattaaaattggcattagtatcaacagtgttacaggggagaaaaaaattgttaaagccagatgtggacccaaaaacccctggaacgatgatgaacatttctttaggtaaaaagcaaacaacataattacaacttttatcttgaaggtcactttttatatgcttctcctcaaaagaacagttctgttgagactttgaaaagttgtcttagcagaagagaagagataaggacaatgtgtgttcagatcacacttggattttcttaactatcaacagttttaggagagtgagcaatggcaggagtaatcaaaagtgctcacacatacccatgctggtgattcaggtcacctatggaataattctatcagtacttacttctgcttccacaaaaatcaatttagagtcaacatggggtagttctagactttcagaaccactggatcacaaacatttactttttttaaaaaaggagttaaaaaagaggatcaatatcatttctagctttctgcaagtaaaggcatttaaaattaactctacctccaccattatcatctactatcactgtcacttcaaaaagataggacatgggatcaggtgtggtggctcacgcctgtaataccaacactttgggaggccgaggtgggtggatcatgaggtcagaagattgagaccatcctggccaacacggtgaaaccctgtctctactaaaaatacaaaaatcagctgggcatagtggcgtgtgcctgtaatcccagctacttgggaggctgaggcaggagaatcccttgaaccagggaaacagagattgcagtgagccgagatcacgccactgcaccccagcctggtgatggaacgagactctgtctaaaaaaaaaaaaaaaaagataggacatgttaatgtaaaagctgtcagaacactcaagacacacaataaaagatagtcctatccaggataagataagcaggcaatcttttgcccacatcctattatgctgttcttattatatttgccagtggcccaagaaatcttacaggtggaccatagggcacatgtccaaggaccagtgtgggggagttaatgctacagctctggaccaggaatctgaaaagaatattttcttctccaactcatcactggcacaaatcagcaaccctgtacaaagctctttctcaacctccaatttgagaactatacttcctaactattcaaaatgctctcacatcagtcaggatattttttcccctaacatatccctgggaagggatgaagtcaaccattaccaaacatttatgaatacagaaacagaaagagatcctgtgtccctctagaggcactggactgcaatcatctggcaacactaccatttttggactctctggaaatggcagagattttctgaaggaaggaccctaaaggcagctgtcctttattgagcatctgtgatgtccctagcgctgcttgtctcattcaagcctcagcactaccaaatgaagaagatgttatgtgtggtgagtacagtaggctgctggaaattaaaaaacctgcacccccatggccaatatcaagttacccaagtggcatccctgaatgcagaattgggaagggagacacaatagcacccccattgtatggtattttctaccacacagacacaataaatgtaacaacctcaagatcttagataatagtaaagtgtaataagaaattaggaaattatgagtttttaatataatttatttaattgtgagtttgtacatttaatttgtaacattagttattagaagaagtttccaatcaatttggagtcaatgtgatggtttttttccagctttcataggtcactacaatccagtgccaacacagcattgggtggatcccatgagatttcaaattccacaaagaaaaaatctacttggtcctcaacattacttccaagattgctggagttcactgtaccaataaaaactcatggacaagaaaacagaaagtaagtcacttgtcagagtttctcttagtaagtgttagaagaaattcatttcatagatcacccattctgataccaggtggcatcaaaatcatcttattaaaagccaggaatgcaattcataataatttcataccataaccaatcctagttccagaataaaaattataacttgaggagagaggttaagcttgtataaaacaaggaaaaataatgaagaagcaaccaagcaacacagtgaaaataaaaaccataggtaaaggcaggtgctgttgtaatttctgccaaacacgaaaacattgtcaagggtaaacatgcaataaaaaagctaaacttgtagcaacagttattcaataatggaaacagagttctctttgctataattatacaaattatattataatacaaaccagctaaaaatcctgattgggcccttaccctctgtgtcactcctttaaaaataaaataaaatctccaattacccaagaattgtaattttcttaattacaatatttttcaatcctgacttcatagattctgaggctcatcttgattcctaaggtgtcaggtaaatgaaaattgtaatctatatccagacaacatggactgtctgaaaatcccatctcaaacacttcacctatctttgagatttgagattattacaatactcactctgtggtagaggaccagttgcccaaggaaggtttgtgctcctcttccatacaatagagttgttgctaggaggccccacaaccactacctaggtggggccatgggacttatttctgtccagtggaatgtggttagaaatgagcaacgcgatcaactttcataaaaacttcctaactagtcctcaactctccctctttttctatctactagctagaagtgaaggacttcaatatccaagaagatggtgtagcctcaagatagaaaaagcccacacttctgaaacatcatttgaaaggctgctgaagacctacatcacatggtgatatgaaataaaaataaacttctattaagttaagcctatgagctttcaggctttatctacagagatctcagctctctctgctttaagaactgcaatggctacaaggcaaattaataccttattagtcctgtattgtttgttgcttttgaatcaccaaagtgattttaacgtgtgattgcttgccaaattttctaaacagacagtaggatgaattggttgctggaggctccaactgcccctaaccatctgagcgatgcacccattatgcactaatcctaaacaactaatgaatttccccaggagcatttgatgtcctctcatataggtatgactgagtataagatttaacttactgtgatagttttcacatgacagtgttattaaatcatgaagtgcaatggtacttaaatttttctgcgtcacagatctctgtaaaaatcaaacaggaggagtggattctttctggaaatggacacaaaagcacatgcaagcaaaatggtgtgcaccatgtcagctggttcacagagcctggatcagcaccccagaagtttacctttgagccagactttgggctgataaccacttattgagaggaaagagcactgtactagaagccaaaagtcaggagcctgcagtcccagcctgagactttgggtatgctgcttcccctctctgatcagcagaatcaggagctttatgaattggtttctaatgctcttccagctctgaaattatccagatttttaataaacagctgacactgaaatgaggacctctagctggtatttctagtcccacctattctcacttttaaaaacaacagaaaaaaataagggaagaaaattggtggcatcacaaaatttaacatctcactgtgacatcaaaccccacattatatattttcctgtaatttcatgacaaggttggctttagctagtgcaaaattgctagctccttcagctgatcaacataaaagtacatgaagagcctagaattttgagcatgaaatctcaagtggttcatcagaatgatacttcttggcgttaatgagagtctagagtcagtgggttaatctggatggacactagcttccaagatgaacctgtcagaataatgttcacacaccacatactttcttcaacagaccaaataataataacaacaagtaaaaacttaactttcattccaaaggtaattattacatttatctggccttttcccattattgttctgtaaatctattactgtataacaaaccaccccaaacttaatggcatcagaccaccaccattgtattatgttcatgaattctaggtcagtttcttgcacaagagcaagaaaactacatggccttttattacctaaccttgaaagtcctatagcaccacttctgtcatgctcttttgaagcagtcacaagcctgcttcctaaaggaaggagtgccaaagaatttgaagccatgttttaaaattgccactattatggaccaacaccaattggaggaatcaataggaaaggaacactaaaatctcaaacatcaactcatgtcagtcttaaaacatgggaggttcagatattcaaataataatttgatacaggggatacaagaaatacagcagtgaaccaaacagaccaatatcccagccttcatagttgtttgtttttttttaaattccagattccagtggaggaaaaggcacgataattttaaaaggagactaaaccacatcgttataaatgttataaaggaaaataaatcagagaagtagaatgggaaatactagggaggcatggatcaattacaacttccaataggatagtcagagaaagcttcatgaaaaggtgacgcttaagcaaagatctaaagcaggggtgtccaatcttttggctttcctaagccacactgaaagaagaagaattgtcttgggccacacataaaatacactaacactaatgaaagttgatgagctaaaaaaaaaaaaaaagtcacaaaaaaactcataatgttttaagaaaatttatgaatttgtgttgggctgcattcaaagccgtcgtggtggcatgcagcccatagaccactgactggacaagcttcatctaacggaaacgagggaacaagctgtgtagatattccaggcagagagaacagtgaaggctaagtgtgtggctgaagttgcatgagggatggggtaagtagaaagccaaagaagtgcaggggtgggtgggaatgagaggatgagctccacatttggagtttgtcgtgaggacattgattttactctgagaaaaatgggaagacattggaaggtctgagcaaaggcaaaccatgacatgaggcactttcttaaaggattactcccaatgttgtattgcagcatggtttcggggtggtggtgataaggacagacccatcagagctagttagaggtaactggaataactcttgcaaggcatgatagaaccttggaccatggtagcagagtggaggcaaggagaaaaagttgagtttagatatgttttgaacatgaggtggacttggcttcctgatagattgcctgaggactaaagagagaagcaaaagatggctccaagcctcttagcctgaacaacaggaaaaatggaagtggaccaccaagacagggaagattgggaaggaaaggtgggagttatgggaactaagagttttggttttgtatgtgttaagtttgtaatgatattagacatttaagtgaaggtgctgagtaggtgattaaatagatgagtctagatttgaggggagaagtaagaactacaatgacaactttgggatcagtgaatagacagtatttaaaacctagatgaatcaaccagggactgagcatagaaagaagagagatcagagtattgaggacaggggtactccaagagtgaggggtcaggaagtcaggagcaagcagcaaaggagcctgagaaggacagctagtgaagtaggaagagaatgaagagcatggcctcctggagatcaagtgaagcagctgtgtccataatgagagcgtggccatcacatcaattgctactgagagatcaataggatgaagctagagaattgaccactggacttagtcaaggtcattagtgacctcatctagagcagtttgggggatggcaggagtgaaagtctaactagcatgtgctgtggaagaacaggaggagagaaaaccctcaggttactatatttgcacagtgggctatttaaccaatcattcatcttgtcaaaactctgctttagatttgtacacccaagttcatagctgcattatcccaataacaaaaaggtagaagcaacccaaatgtccatagatgaatgaatgataaacaaaatgccatgtaaacatacaatggaatattattcagccataaaaggacggaaattttaatgcctgctacaacatggatagacctcaaggacattatgttaagtgaaataagccagacaaatactgcatgatctcacttatgataggtatctagagtagacaaacttatcgaaatagaaagtgaaatggtgcttgccaggggtggtgataggcagaaatgaggagttgtataatgggtacagagtttcagttttgcaagatgaaaaagtcctagagattggttgtacaacaatgtaaatatgcttaacactattgaactgtacatttaaaagtggttaagacagtaaattttatatcatgtgtattttaccacaattaaaagtttttctaaaacagaaacagaaattgttgaagacccacaaccgttcccatctctatcctttcggagagtaaccatcatcttgaagttggtgtctatctttttcatgcatgtttttgtgctttcattatgtatgtatgtcctcataaataacataaagctaacaatacagtacgctattttttaacttacagaaataccagctgtctattgcacaaagcttttttgcattttgggttttacccaacaatatttatgttttcaaactttatcaatgatattaagtaattctataagtaagtgtttcctactcttttttccattacaaacagtgtttcaataaacctctcagtacatggaggcgtggagaatcaaatgtgttttaggtatcttaaatgcgcaataattctcttctttctaaaacatactgttatttctgtttggaataatactccacccttttattcccttttgtctacagaggttatcaaactacagcccacagaccaaatccagcccaccatctcttctggtaaataaagttttattggaacgctgctatgcacattgatttccacattatttatggctgctttcatgctgcaatggcagaactgagtggttgtgacagagaacatatggccctgcaaagctgaaaatagttacgatctggccctttatagaaaagtttgtcaacccttggtctaggatatcttcaaaactcatactagccaatctcaggaaaaagaattactcctcaggtggtagtttaaatcatgtccacaaattcttcaacattctctttataaagtgaagcctaaatgtcttctccttcactgtagactggactcagtaactcacttctaacaaatagaataaggtggaagtgacatgtttgacttctgaggcctaggtttaaaagaaattatggcttctttcttgctcatattcttggatcacttgttttggtagatggcagctgccacatcatgaggatatcaagacatcctatggtgaggcctgtgtgacaggaaactgaggcctcctgccaaaagccctgcgaatgagccatcaaaaaagtggatcatccagtcccattcaagccttcagatgactgcagccctgtccaacagcctgattgcaacctcataaggggcactgggccagaactacccagctaagcaactcccaaattcctgacctacagagtctgtgagataataaaggtttgttgttttaagccattaaatttggggtaatgtgttatgcagccatatattgcaaatatatcacaggaaggtcaacagctgaccctctagactagtctaacattccatacactcatgtatactctcatagcattgtgtacttttcctccatgtcactgaacatggccacaattttacactaatttataaaattaattaatccatgtctgtgtatatcatggagtggtaaactccatgagaacagtgactctatgcccattacatgctcagtaattaacacagtgcctgccaacagtaggcgctcaacaaacactgatggcttgattaaatgaaaccgtacaaatgacactgtatgtataagcctggaagtcctacagtactttcgaccaaaaggagtctgctgtgaaggatgataataactaacagttacttacacattgctatgcgctaagcactcttttaagtatttaataaatattaatgtgttcaatccccaaaataacctccctaagtaggtattatcaccattttattatcaccatttttcacttgaagaaacagaaatagagaagttattaacttactcaagaaaaccttactgaactgtactgcagaaatttatcccaggcagtctgactccagagccactgctcctaattgcctccctacactgcccccgtttcaccacttggctttgagttgatatttgaagttgacacctccattggcttctttcattataggcacttccctatttctcctttgattcagtctcatttcccattcttttcttcagtatttgaaaatgaaagaattttatcatagtagcagttgtctgagaccaatgtccatattagatattaaaacttaaaaggcaaacatggttggcacacagaagaagtggggcaaaaaaaaaccacaattactttcaaattttaataaccttctcaatctttgaccaatcaagcgtttataaataataacctaaaatatttacataatagaattaataagcctaaattaatagacagttacactgaactttggatccaataacctccatttgaagactcaatggaatatttaaagattgaccccataccaggccaccaaggaaaacctcagatggattccaaaaggcaaaagttaatatacaggctacattctttgtccatacacaataaagcaagaagttaaaaataaaagttgaaaataaaacctcactatttggaaaataaagctcataaaatctttaaatttaccctctagagtgagatcctgtcctctccacttactaggtgcatgaccttgggcaagttactggattttctctaatactcagtttcctcatggatgtcacagctatttcatcgcgtagagaggttgggataaatatatggactgacacacagcatacaatcatcattgaaatgtatccttatgactgtttttgctctttaatgattattagtgttcccgacagcacattaaagaaggcagtctggcagaatgccttccctgcctctttgttctgtgctctgacattggctagcattaatacactgtcactgggtctaattgaataattttcatttagcaaaaatccactattggccaggtaggacacacagagaatccctgccttcacggagcttatgttctagtgcatgcattctcaatgagggtgacgtcatgcctagaggatttggggaacggcaagtttcccagggttgttggagtggaaagaatgctgaggagaatgctgagagatgagatccaagaggtaagggctgcagagggggcagaatgtattagcccatatataaagatatatataaaaatatctttatattcttataaagatatttgtcatacacagaaggcttcaaattctagagagacagggaaacagtttccatggaaatagataaatacagtaggaagttattagtaaattatttttcagctgtcacaagtaaatggacatttgggagcctaaaactatgctatctgaatctctgtgcatgtacatttttctttaatttgtcttaatggataatgtgctccttttggtgaatctgcattaaagactttttcacagattcatcttggtcctttagatgttatggtcctggaaaccacagaaattaatagaatgaaattctattaatatttggccagttgtgttatgttagcaatgtcatagggagaaacaataaaatttagttatgtagttcaataattattggacacctaacacatgttaagcaatgcagagacagcaaagataaatgaaacaccatcccaggtctcaaggaacttgactgtctaatggaaaagggaatatatttcctggaatataagaccacaaatgttaatttcaacaataataacagcagctataacttacacaatgattatcatatgtaaagccccatgcttcccatctagtgcctgatttgctctgcacagcattccaccacataggacttaccgccccatggaaaaggtgcagccactcagactgagagagttaggtaacatacccaagattgcaagggtggtaagacctgagtacaagcacggtcagtctgaggtctaaactcgctcttttaattactaacataacacttggtttatattgctatctgcagttgcttcatcctctgcaaacatctagtattttaacagggatctgaatctgactcttggtttgtttctcagttccctgatagaaccccactcattttgaatgacatgctatgagagagaatgcaaaataagcatccaggcctgatgagggaagaatggctttggaaaacctcatggaagagtacatgtgggtgattaatcttcaaccagctttgcactactctgttggactccatttctgagctaaaatacacctccctgaaccttatgcactggcctttgtccctctcatttggggacataaagaacaaattgggccaatctgccactgtgacagctttctagtccaaagtttttcttactaaagaatcattattctatttcttacatgacagagtgtcctggtcactcacctcagcctatgcatctcatctcatctgatctcagaagctaagcaatattgggcctggttagtattggggtgagagagcagctggaaaaactgggtgctgtaggctttgagtgcagaggcaagaaccatggagtattattcccatactttaaaacctcatggatttcccagctggattttaaaactgcaatggaccagtggctccatcttaccttccttgttacctatttgaacattatattcatctgtaactgttatcctatgcctctaccaccattatctattgagagcagataacttgtttctctcattttgcaagcccactaaaagagggaaattgtgtccccaggagtggtatttaatggattatacccagagcctcatccatacataagcgatttagacaatgggacttttgaactgatgagatttagatgagattttggactgagttgatgctgcaatgggatgagagctttgaagatctgggatgaggtgaatgtatttattactttggaggaatgtgaatctttgggagtcagagggtgaaatgtagtgggcagaataaaaaagaagtccactttctatttctaaaacttactaatatgttacattatatggcaaaagaggctttgtatttgtaattaagattacagacattaaaatagggagattatcctggataatctgggtgagtgcaatctaatcacatgtgccttataaaagctgagaactttctctggctggaggcagagagagatgcggcagatgaggatgtcagagagattctcagtgtgagaaggatttgatgtgtcattgctgattctgagatgtaggggccacatcatgtgcaaggaccacaggaagcctctaagggctcagggtggcccccagctgatgaccaacaaggaaatcaggaccttggacctacaaatgcaaggaagtggctttggccaaccacctaaatgatttgaaagcatatacatctcaagaaccttaaaaaaaaaaaaaaaaaaaaaaaaaaaaaagagcacagccctgatgatacttaattttgaccttgtagaacttgaagcaaaaaatctagttgagttgtgctataccaggatacttctgacctgtgagctaataaatctgtgttgtttaagctgctaaacatgtggtaatttgtcatggctgcaatagaaaactaatattgaatagctaatctctcctttgcactcctctgttggagagtttttttttctgcattgaggggaaataattcccctgaagcttccatacactggcctttgttctactcattcaagggcataaagaacaaatcaggttcatctccgatgataacagtatccaagtccaatgtctttcttactacagggtccttttgttgttgttggttttgtttgtttgtttgttttgttttgtttttgagacagagtttcgctcttgttgcccaggctggagtgcaatggtgtgatctcagctcactgcaacctctgccctctgcctcctgggttcaggtgattctcctgcctcagcctcctgagtagctgggattacaggtgcctgccaccatgcctggctaatttttgtatttttaatagagacagggtttcaccatgttggcgagactggtcatgaactcttgacctcagatgatctgcccacctcggcctcccaaagttctgggattacaggcataagccaccgcacccggccagtcctactgtttcttatatggcacgatatcaggtgctattagcaacccctgggtcacttaccttagtctacttctatatgtcaggttgaattcctgagaagcagagcctgagacaaggacttccatgcaagtggtttattaagagagggctcttcaggaaagctttaagggagggaaagatgccatatagagaagacagggaagttaagcaagggtgttgtataggaaatctaacctgagcctggacttgcagggagctctagagagtaagctatgctgtagtctgttccccttgaggcaagggggctgggcttctgtaccctcgctccagtcagcctctgcctgtgggttcccccagcacttctggacaggaaaaagtttggcaattctagtcatgaaaggcacacttccaggaaaggtcacagatatgagctgttggcaacagcactcacagccactggaggatgggtgcatctgcccagcaaaagggttgctaggggtctgaattgggcaaaatgagcatctgttacaatctacgattcagaggttgtacacagaactccaggttttatctgaaccagcatggagtaaatagggtaggactccattatttttgttttaggtaagtggctttaaaacttattttagcagtataagccttcaagcttgttttgtccccagatgagatgcacgcacatacacgcatccacacactaaaattaattaagcatctactatttgttagacactgttataggtcctgcagacaggaaggaattaagacggaatggctgctaccaccatgaggcttactgtctgttatagacagcagtcagaaatacgtaaatcaacaagttaaaaattgtaaatgtatacaggtaataagtgctttacaaacaacagcaataagaagatgctgagatagagaatgatgggggagggaattataggatccatatgaggtctgcctcccaaacatgtagtataaatgtcaactcgctagccctaaagtgcagtaccaattaagacattgtatcttcccctgttatcatcccactctaactttaagctggcagtcaggcaaggtcccccaaaggagatgacactcaaaccaagacctgaaggatgagcaggaaccagcacgcaaacacctgtggggaacgtggtcaaggcagagggaacaggaagaggaaagaagtggatttgctctgattaatagggtgacagggggaggaaagggcctgtcatccatccactaagtccactgcaaggatccctgaggtgtcttcttgaaactctaaggttcctctgaacacaacttgagggccacccttctgggcatcatattttgagtcccagagtctaaaactggattgaagaaagcctctggctctccatccagttgccctcaggagccacccaaacatcattccacattcctggatctttacacatcttccctcacacccctttctctctcgagtacgtggagaaggcgtgggagagggagggtctggctgcttcacagctccagccagagggcccattttagagatgccagcaaggaatggcatatgaatcaacagcgtgttccctacacacccccacggtccagatggctgcagatcgcaggagcagagggcggctcctacacagacaacttccctggctgcagacacgtgccacacttcagaccatgagagaacacagttatggtggtggtggtggtggcagcggtggtggtggtgacatttttacagaaaagggcatggtctttcttttgctgcagattttcatttcaaacacttgtctgtaatgaagccttgtagtataaaatgctgagggctcacagaattggaaagcaccatgggaacaagctggtccagcttctctctcccagcctaaatcttttcacatccttgatgggggtcactgggctgaagcctgaaagatttcagattggggcagtcatgcctccgtgacgcagctctgatagttggaaagttctctccttataaatgttaagccaaaatctgctgtccgactctcccctctttggtctagttcctcattacacaaaatttaataacatcttactggccattcatcaaggtcttgccatgcaccaagcattgcgctaacaacttgccatgaaatatttcatttaacccacaccccaaacttaggaggtaagcaccaatcttatccccagttttcaggaggaaaccagagtcttgaagaggttaatggagcagcctaagaccagaccactggaaagcaaaactgaggtttgggcccacatctgtcattctccaaagatccgtcaagcttttgacagctacacagcataacctccacagaatgaatctgtttctttcttcataagacggttctccaagtatgggaagccagaccactgctctcttctaaggacttttcttctttacgtgagatacctccaggtcattcaactgttcttgatggaatgcaagagctcaaataagaaccatcctggtgactcttctgtggaaaagctgcggcttctaattgtcctaaaatgtggtgtcaagaactggccattccacgcacagcctgacaacagcagcatctgttgagtccatccttctgggtctactcaggccgctgaaaatctggtcagaatttgaacagctgtgaatgatgctgttctgcatcaaactaagatgttcctgaatcagaaatggtgtgtccatacatgtgtgggacaaagtaaggggttctgtatcaaggggctcacagtgaacaagtccgggccaatccccctagagaattgccttctgtgagggctgttcttggcatcccccatagaattttccaacatttggcttgcaggcaccacacatggagccttttaagccattatccatgcatggaattggagctttagggtatcagatggtgaacacaacccgctggcactctctgcaagccaaccctccacctgctcaaaaacctcaccatctaatctctgcagccaggtccaagcaactctggaatattttatggcatttgcccttattttattaaaattagaggaaaactgaagcaaaaggactgacataagtgacaacacatgaaagcccaaggactgagacaggtggcattagtgagttttatagtgttcaaaatggttcatctttagcatgaatatgatgccttaagccaggcctcaagtatgaggctaagcgacaaaattgttaaggctgccagaaggggatccctaaaggctgtatctaaaaaatgaaatggaattagggatggtagaatttttttcacatctctggtaacagtggtcccttcctcctataaaacatgtaagtacaattactgacttttgaacattttatttgcaaacctcttcttgctctgccaccaacaagctgtgaaaccttgggcagggtgctagccctttctgtggctcacagcctcatctgtaaatggggatgacagctgcaaccacctcattgagttgtgagaatgaagtggttaccaggtgtaaagccagccagcagtggtgccaggagagtatctggaacatagttcaataagtgttagctatctgtctattcatttaagacaaggtctcactctgttgcccaggctagagtacagtggtgcaatcatagctcactgcagcctcaacctccctgagctcaagcgatccccccacctcagcctcccaagtaagctgggaccataggtgcatgccatcatgccctgctaactttttaaaatttttttgtagagatgaggtcttgcttagttgaccaggttggtctcaaattcctgggttcaagtgatcctcccacctcagtgtcccaagaggctgggaccacaggtgcatgccaccacacccagataattttttttatttttgtagagatggggtctcatcttgttgcctaggctgttctcaagctcctgggttcaagagaccctcccacctcggcctcccaaagtgctgagattacagatatgagtgactgcacccagccaagtgttagctatttaacatttatgtaatagtatgacccaagtgaaaagataacatcctcataacagcctggagtacagagggcaccaagataagtcaatgcaggaagagcagggtgctagaaaaagggtgtgtatcctgacagggagccaggaatagtcacaaagagaggttgctccaagatgccaggtggtctctttagcaaaatgtaacagagaggcaacctgagcagaagggcacaggtggagttacaggcacaggcagagctggccaaggggaggccctggaagagaccttgctaggcaggctggtagccagaggtaggtaggcaggcagtgggagggaaacccaggggagaactgtggttttcagggggtccagggaaaacatgccaggcctcagtgttggagcaagaggtatagagtcctcagccacgtactacccctggaggaggcacactgcaaactgtctgagtctctgacctagctccccagcatgcagcataccctctggcacacggctgaaataacagcacctaatatccatcaccaagtgtcctctctatgcctgagccagtttaggtcttcttcatggtctctctcacacaaccttcactcacaactccatgagatcctgcaatcaacctcattttacagaggaggggagtaaggtccagagaggtgaagtgacttgcctaagtgctcagatgaaggatagatgaacagatgggcaggtagatgaaataaggttgcagtgctgtcgcaaacccaagacagaaaaccgtttcctagaaagatgttgcacatcaccctccaatctcatccccagccagttaactaccctgatgttcccctgactgcagtcacactcacccacatacactcccccaccccagacaccaggttcacacttacccaggaggtcccttctattacattcccttcagtcatgaactcggatgaactcaaatctcatctgctgcacaggccacacacacacacacctgtgcacaaatgtctcaattctttcctcccatcctgtactttgcttttatttgcattagaacactgataactatagtcaatatttcaggtattaatagtgtccatgtagcaggtacatgttaagtatacatgttctgtgtcctttaatcttcacagttgttcccattttataggcaagaaaactgagaaaactaagtgactggcctaaaataacacaattcagattcaatctccagcctttcctcttagccattattacctacatctctccaacattcttcatgcatgaatatagttatgtctcccacaggatctctgggagggttgggcagaatgtggcactctgctctctaacatgactccacagtgtctcacccaaggttgacactccccattgtttgctaaatttacttaacttctttaagttccatccatgtttaaaatgaggttaatagttgtaacagggcctagcacatagtaagcatgagataaatgtctattaaataactaaaataactcctggaaaataatgtacataatctcatttatattctatccatttatttctactcgatagtgttccagaagaagtttaaagcaagccttacatcaatcctctgtggggcatattattatccccacttaacagctgagaaactgagggtcagagaattcatgaaattttacttaagtcacagggttggtgagcagctgatgtgatttaaacccaggcctccctaaacacagagaccatgctttctattacaagagactcaggctgggacccaggcaggagtgggaatcaccataagatggacttgatgctgtgtcacctgtaccaggtgaattgtcttcaatgagaggggcaatggggtcttggaatggagctaagcctgaagaaggtgacccattggcctcagtcatggcccaatggggaactgaagatctttagatactgggatcccagcagatcttaaccaagtccacaggaaacacattcatttgacaatgggtatcagttttccataaggtctcccactaagtagtaccactaaggccagcaatcatcccaatgaaaagggtcccaaaggcagaggaattatttgagctgcactgtccataaactacctacccgattttgactctcctttgtgtataactgtttaatcaatttacaaaacaggtatatggtagattggcagcctatattaatgatgttgggaaagaaaattcatgaatacagggaaatgttcacaataggttaaatgaaaagagtagtttagaaaacagtgtgtactccttgttttaataagaaaatataaaccgtgtgaaaaagtgactgaaagaatatatatcaaactgtgtgctggctcacgtctgtactcccagcactttgggaggccgaggcaggaggatcactcaggagttcgagatcagcctggccaacatggcaaaaccccgtctctactgaaaatacaaaaattagcagggagtggtggcacatgcatgtaatcccagctattcaggagactgaggcaagagaatcgcttgaatctagaggcagaggttgcagtgagccaagatcatgccaccacactcaagcctgggtgaccgagcgagactctgtctcaaaaaaaaaaaaaatcaaaatgttaccagaaattagttgtaggcaagatcgtgagtaattttcaagtttcttttttgtaaatctgtactttctaaattgcctaaaatgagcacacattaattgcataagaatttatgcatagtttttttaacttccaatgcatgagctcattttcatcatgacaagaaactgatgagaccagtactattattatccccattttgcaacagagaaacctgaggcccagagaggttaaatcacttgcccaaagtcttagaaccttgtgattggtttgaatccgaaagccaaattccacagcccaaatgctggatctcatagggacagcatgagtaaaagcgtggcaataaaatagccaggttaaggacacttctatgtttatggtcctatttggtctttataacttttctggtgagttagacagggctaccaataaactgggactcagggaggttaattagtttgggaagatcatccaataagctagtcatcagctcttatcaaattattcattgctttagtgtctacattttccatcatgccataaggtccctaatgacaagtaaatcatctgttttattcactgctatatccctagcatgtgacaaatacccaacatgtagtaggtactcatataaagatttttttgaagagtgaaagaatagaactaaaaaacagtatgtgttgagttgaatagtgccccctcctcccgccaccaccccacaaaagaagatctatccatccagaatccgtggattaactttatttggaaaaaaaaggtatttgcagatataattaaattaaggatctcaagatgagataatcctagattatgcggcgaggcccgatccaatgatgtccaatgtgcttataagagaaacggcaggcaccactgtactctacagcctgggagacagagtgagaccgtctcttaaaacaaagaaagccaaaggcataaaagatgaaaaatggtctacctatacagggcacttaccatgaatggagtttgtaggactggaagttgctctggatcagtgagtgagtgagtggtgagtgaatgtgaaggccgaggacattattgtacactactgtaggctttataagcactgtacacttaggctacactgactttattttttaaaataaagtaattgtgctacagcgttacaacagctaagacatcactaggggataggaatttttcagctccattataatcttatgggaccattgtcatatgtggcccacagctgactgaaacatcattatgcagtgcatgacagcaggcttgaaaaaaacgtgaaatttacctctaatcccactgtgagagataactgcagtcaacggtgtggcacagacatgtttctagatcttttctacatgaatgtgtgtacaatagtcctcacttatccaaggagaatatattctaatacctccaatagatacctaaaaccacagatagtaccaaaccctgtatatactattatattacctatgatgaagctgaatttacaaattagacacagtaagagattaacaataataaccaataataaaatagaacaattataacaacatgccaacatcactgctcttgggctttggggccattattaagtaaataagggttccttgaacacaagcactacgataccatgacaactgatctgatcaccaagatggctggctacaagtgactaataggaaggtggcatagacagcatggagaccctggacaaagggaagattcacgtcttaggtgggacaaagcagaacagcgtgagatttcatcatgctacttagaatggcatgcaatttaaaacttatgaattgtttatttctggaattttccatttaatattttctgaccaatgatgactgtgaataactgaaaaaaatgcaaagaaaaatcgtggataagggggaactactatatatatgtatgtttagggatgtgtttgtgtgtgcgtgtgtgcgtgtgtgtgtgtgtgtgtgttctctccaattaaaataggacaatactggccaggtgcagtggctcatgcctgtaatcccagcactttggggagtagaggtgggaggattgctggagtccaggagttcaagaccagcctgggcaacataggaaaccttgtctctacaaaaaatacaaaaattatctgggcatggtggtgtacctgtagtcccagctactggggactctgaggcaggaagatcacttgagcccgaggggtcaaggcttcagtgagctgagattgtgccactgcatcccagcctgggtgacagagcaagaccctgtctctaaaataagaaaaaaaaaataggtcaataccatacatgctgtgaggaagtctactgtctgcacttaacattgaatcctaataacctgatcctttgtgtaaacctgaccatcaggacagcaggggacaaaggaggccaggggagcagtaggagtggcccaccacagcacagagtgttgtatcactgcattgtttagaaacaccaaagcacgaggagagtatatgcatactgatttttagccagctaaaaattactgttctaggtcttctgcagataatccacactactattgctgctcctaggtgggctgcatccaccacctccccttggcaagctgctacaccagggaagatggtggtttgggtggggcaggggatgggcatgcttcaccagaaggcaacacgacagaaggtacacactacgtgctcattagacaaagttagaaaaccatcccacactccctcctcacagagatcttgattaaacatatgagataatgtccactatatcttttgtgatcttgagaggaaaagcactagaataggtaaatttaagtatattaaaaatacagcccattttccatcaagtccaggcaatggtatccacagtcaagcagttcccctctaaactcgctgctgagtcacaggacagatgactttcttgccttcttttttttttttttttttttagcatatcaaagaccaaaacttcttgagatgagttattgagaagatataagggaaactgaataaactgctttaaaaaccatcaacctgtccacaaagacacaaatagattttagcttctaacaactacagtggtataattttcctgttagccatttcccttgaaataataattgaactggcaagtccattcctcataaacactttcatcatctgtggcttgacgaggcctagctactgagccacagataaatgtttcttcaagatagtaaatcatgagccatatgttagaaattacccttcacccctataaatgggactataccccgctttgtcctttccaaaacagtggaggggatttttggcagccagactcacattagaatccctgggaataacactgctaatccccagcatgacactctgaagccttcagagtcatatttcacaatagtattttcacagtgtctgcagagtccgtgtttataaaaacagattcaaaacaattaaaaaaacataactggaaactgaactccagccatgtcaggtgtgaaaaaagctcttggtactggctttgcacatgcctgagatacaggcatgatcctaagaaatagcaaaatgtcatgatggaaagccccagctctgcagccccagtggcctgaattcaaaatctggctcctctcatttctaggtgtgtggcctcgggcaagtaacttggcctctctgtgtctcagcttcagtatctgtaaaatgggaatggtgataatgcttgcttcacagggataaaagagttaaatgtgacaatataaatgcttctaaacttcctgatcacagctttctgaaactacgttagaatacgcctaccatagcaaacacttaagggacaagttgagtcaagggttttataggccaagcctggaggtggaatattcacttttgttcatattccattagccagaatttagtcacatgaccacacatgcaaaggtatccaggaaatatagtccagttgtgtacacagtgaagaagaggggaacacaataatggtagcaatagccgtctgtacaacacacatttaatagaaactaaagtttcatgaaacaactcctccacttactatacatgagaaagggtgatatttctgttttactccattccattccatactaatctatttcatttaaaacacattggtcttcacccaactggctgattttcacaatccactgatatttcacaattcactatttcctcaacaagtgtttgctgttgtcattggcaatggtagtggcagtgagcaaaaggataaactagatacttccaaatttttccaaaaattcttagtgtttgggttcacaagactttacagtgatgacatactctagttttgacttcaagtattaggagtcagaaatatgcatctagaaacactgatcaattcctggaacctaggctgcctgtggaacacgtagttaactataatcatacattgtaggaactaagaggaataaacattcacacacacacatgttgcatgcatacaaatggatgatgaccaacaaaaagaggccagaggagacataaaggagaaagagccaaggcaagaaaaagggaaatttgtccattctggacacataacactggcacagagcccagaacagaggaagcaccaggtactgctttctcaatgaatgaaccagtgatgcatcaggtcttgctcctcagctccttgccctagaaattcctcacaacctgtgcataagttagttcaatgttcttccctggccttcttaatgggctaaggaatttgaccttgctttgaatagtcacagaggcagtgtaagggtttaagatgggtaggacatgatcaaatgtgcatttcagatggatacctagggttgtactgtggctggcctgacctgaagcagggaggccagggaggaggtcagaggagactgcggcctgagctatggcagatgataggtagagaaagaagggccctgaatcagagaatacacagatgtccaaactgataggtgtgggtgactgatttggagataggatgctcagacttctgacttgggacaactgagtacatgaaagtgctatttgttgagataaaaaacacagaaagagaaaaagagaatttgatgaatccaatttttgtacaagttgtttcttaggcctctgacgttcagtcaaaatatgcccagttggcagtgggagcgtggactggaggtaaggaaagagtgctgtgtagactcaggttgagaattattatcaaatgaatgatggttaaagtaagaggatcaccctgggactgggtccagactatacaagatcacaggccaccacaacaactcccaaccttggggccgccagcccactgtaccacagaagtggcgaataggaatgagcttagatgcccaccagacataaggggaaaccacctaatgcctaggtgaccctggattatggctcagtttctttattcattcaacaggtatttattgagcatctattatatgacaggcactgtgctaaggactaaagaaaccacggtaaacaagaaagacatggtacctatgcatgatctgttgggtaaggcagctgaaaacaaggaagcaaattttaacactcaaattgttgggaaatgctatgaaggaaacaaacagggtgttgaggccaagaatgctggggaaggggaaggatctactgagaatacaagattagagaagccttctcttaacaggtgacatttaaatggagacctcaagggtgaaaaagaacccagtggggaatggtaagcagagtgaactggattctagacaaaggcaaaggaaagagattggatgtttgaaaaactgacaggtaagtgttctggagctgagaaaacaaggggagtggtaattaagggttagatcatgagaaggagtttgattttaactctaaaggacattgaatatgttcaagcagaagaataacatgatacaccacacacattttttcccctagagacagagtgttgttctgtcacccaggctggagtggaggggcatcatcatagctcactgcagcctcaaactcctgggctcaagtgatcctcccacctaagtctcccaggaagctaggactacagatgcataccaccacacctggctaattctttaatttttttgtaaagtcagggtctcactacgttgccgaggctgctctggaacccctgggctcaagtaatcctcccatcttggcctcccaaagcactgggattgcagatgtgagccactatgcctggccagccatacgctttttaagagcaccactctggctgccatgtggagaatggatgaaggagaaactgtggactcaggacactagataagaagggaatgatgatggtgatctatacaagaggataagtaggggtgatgcagaggagtcaaatggctttgaaatataattggaggtatagtctttaggacatggttataaataggatgtgtgggtatgaggaataatcaaagatgatttctaagtttccagcttcagcaactgaatggattgaatacctatctctcaagagttagggttactgtgaggaattcagactataatatttatacatcacccagcaccagggccagtacattaggtgagtggctataaacaggaggcttcctcaccattactgcattactcttcccccaagaaaccctcacacagagcaggtttaatgacttctctgtcctcatttttcactcacctccatcacacagaatccaggactattctcttcacttttttcccacacagtttgcctactcaaatactcaggggaaaaaaaaaaaaaaactacctagtatctttttactaagaaaaatatctttcctcccagctctaacaagttactcagattaatcagttcctcccaccagggccaccctcacccaactgtgaatcagaaagtgttcctatcctcatgtctaaaactccaagtggctgttgtccaaagatgtgagtctagaaatgcccccaagcaaaattcatatctgagagcctagcaattatttccaataatattcctcacattaacaccatgtgtcttttagtaactgagtcaactttctgctgcttaggctaaggtgacttgaggagaatactccatagatacaaaagggggaattgcaaagacttcaaggattacacaaaagaaggaagccgtctgtgtttgttggaaccaggtcgtaccagctcaggagctgaaatccccaactatccattaaaagaaattatgtcggtagcttgaaatgggccatggtgggagtaactatgccagagaaatctgcaaatactacaaatcaggaatttcattccccatccattatgacagccggttgttaaacgtttaccagcacatcatgggaagcagcttttgtttttaagctaccatttaatgggcaattactatgtgccaggcactgtgctaagtaccttactcatgtgacctccctctgctcagcaacccccagtttgctgaccttgtcagagttcttggtactcatcttgctgtctcatcccacctcatctaaactttcttcagtccttctgcctggttttcccttctctccccatcctatcttcactaccatctccctaacatctgacacagctccccttaggaagcctttgctgaattcctcaagaattaaatccagcaaactatctaccatataccaagcaaacagaattattgctcctctgtatcccttctgtgtcacatacagacttgtctcatggacgttaattacttgaattatgtgaaaatgcccatttagttttacttataaaacatatgatggagcccttctggggtcagttcactcttctcagaagaactgtatggaaaccaaaactttattccaaggagtgtgaaaagtcagcaaggcccaagccctctttccttaattgtcttttcctttctaaggaactaggaatagaattagtaaaacagagcttgaagcaattctaagaatctcattaaaatatgtgtctggcaaagaattcattcccaacactcaataatcctctgtttatacatatgcagcccagccaccagggaaggactgatcaaagccatttgcttcagtgggtacaacaggctacaccctcagtagaaacccaaactgttaggcaagttctttttaaaaacacaagacaatatataactatcggacacataaatgttgctatcagcaaagaataaaaggttaagaatatgctcttattcataataaaatagttcccatggaacaatttcttctttacaacagtaggagagcaacatcttactatgtttccagcgaattcttctttccttctggaagcctgttttctggatcagtttcagaaaggatgctttattaacatgcttagctacatgagaagcaaatgctgccattaactcagagtcaaattgcaaaaacataacttcttccagttcctgaatcaaaatagtcatcagtctgttggtttggccatctttgtattccaccattaggcagaataccgcaggccatctgagcacagcacaaggttttagcttgctgcaacatccaaagtctgcagtcactttccctagtaacccgtaataaccccaagaacatccccaggtaaaaacctcatttgggttttgaaagcctcaaattaccttatccatgaattgcagtgcattttagcagggcataaaaattattcatgttgaggataaaaactaatttctcttaattatccaaaacacattaaacacgtttataaatagctataaaggtaagttaaaattccaaaatttaattataatgattttgcatttatagagtctccaggaacatcctaactcatatgcaagaactcaaatgcaactgcactgcaatctacagcaaaagagagtttgcaaacataatagggtattctgagcatctctaaactcaagcttttttttttttgcttatttatagatgtatttatatgcggctttatgggggtataaatgaccaaaaaattatatatatttaaggtatacaatgtaatgttttaatatagatatacattgtgaaatgattgtcacaaggaaatcctgtcatttgcaaaaacatacataaacctagaggaaattaggctaagtgaaatttgccagatatatatgatatgtatggaacctaaagaagttaaactcataaaaacagacagtagaaggggacaaattttcagttataagatgaataagttctagagatctattgtacagcatagtgactacagttaatgataatcacatacatgaaatttgctaagaggtagatcttaagtgttctaaccacaaaaaaaggcaggtaactgtgaggtgatgaatatggtaagctcaagctcttaagaaaacaagcctttgctattaacttctttagaaaaaataaaatgcattccacaaccactgacattgaaatcacacatgtcttaggtctaaagaatcatgggccttcaagctaagaaagctcttgggtaaaagataagttggtattgtacctgggctcgtatttcctgaaagacagtatagaagtttctttgtgcagctgaaacataaacctcttagggaaacatttctgcccattaccagcttatcagagaccatcaagaatgggatcacccagtatctccttcttgatttgattaaactatcattaagtgcctgagagatggacagtggcctgacagcctctgaccttaaagtaactctaagagctatttgtagaagctgaaggagaccggatttttcgtccacttttgtagttcgtgacctttggcttaaaaggggtacaattaggtcttactcatgctgattaaggcaaaaataaagaattatttctgactggagaaaaccccaattattaagttatcgtatactctccaattgtctataattttacagcaatttcactaaaatctgcatcaaacgttttctacatgacttaataaataaaataccaattaaaatgttccaggtatgaggaaaaggcacattctcctatctaaattgtgtttatgacatatcagggattgagtatcccctgaatcatcccaattattttgtgactattctccagaaaagaagcatattaaaaacaaaatatacaaaggtcaaattgaaaccctggaaataggaatgatgatactatttacagtggacgtgggaggaccatatgagtggaggaaggtactggataagtgctaactgagtgatatctcaaaataagatcacagattaatctaaagaaccaccttgtgcagaggacctgacaagagatgtcttacattgctttaggaaaaaactaacaggccgggcctggtggcttacgcctgtaatcccagcactttgggaggccgaggcaggtgaatcacgaggtcaggagttcaagaccagcctggccaagatggtgaaaccccgtctctactaaaaatacacacacaaaaaaaagttagccgggcgtggtggcagtcacctgtaatcccagctactcaggagactgaggcagataattgcttgaacacaggaggcagaggctgcagtgagccaagatcacaccactgcactccagcctgggagacagaaagagactctgtctcaaaacaaaaaggaaaatgctaacaatacaactttgagtgcatcaggttgctctaagtgccatgaggacaggggttgtttgtcttgctcacaacagagtactctcatctcccaacatggtgcgtggtacacagtaggtattcaaaaaatacttgtgggttggatgcatgatttaactttacttttgctctgctaactatgtaaagtctcacttttattaagagacacacaaacatttgtaattagttctcctaaagtttttaatgtgacacaaacatttaattagatgcttttattttattttattttattttattttattttattttattttttgagacggaatctcactctgtcgccagcctggagtgcagtgacgtgatcttggctcactgcaactctgcctcttgggttcaagtgattctcctacctcagcctcctgagtagctgggattacagtcgtgtaccaccatgcccagctactttttgtatgtttaatagagatagggtttcaccacactggccaggatggtcttgatctcttgacctcatgatccacctgcctcagcctcccaaagtgctggaattacaggtgtgagccaccgcacccagcctagatgcatattttgaaaacactggaatatcttcacagtcacatcaataagatacaagattgtccccaaaacagccacttacactcagaaaaaaagttttttttttaaccatgggacgtgtctgtgtgtgtgtgtgtgtgtgtgtgtgtgtgtatgtctgtctgtctcattataaagccacatgctggatttaagttgtctttgaattctttctcttcaaaagtactttcacataaactcttttaacactccataaaactctgccttttcctaatgtaactgcttgcctcatgtagaatctcaacttctttggacaaaaagcagacccagtccttactatctgccacccaggctttgacatctccttcactgaagaaatcagcaaggaatatgataaccaggtttcatctgattttctttttcaggccatggacgactaaatgcttgatcagagcaagcaggaccctgtgttccataatcatgtgtgacaatacgtaaaattgctatggaaattttcctcattaagcccatctgcaaatgtttgtccccaagtccagggtgcactcttagaaagaggagtatctttttacaatttgggtcactggagtgcattgcattctgagcaggaccccaattactctagcatctgattaatgtctgtccaaactcttgccccgtaacaagaccctctgtaactcagctaaccacctaacaacccacatcattagggcctattatcttttacaatgttgattcttggtatccaagggctgtggttcagacaaactatttaaaggcattaaaataacaaccgtcttgccagctgtgggcatggccaccgaaactaccaccaggtcacaaaaccagatgcaacagatgccaggaagaagactaaaaggcagagggaacacccacttgagaaaacaaatccacttgtgtcctacaggagagcactgggcagcaaatcccaaggtctggagaatcaatagctggtaagagagatgtagcactccacatcctttacctaaccctgctgaatggctctctgaaattttatctcctttcttgccaaatttaaccttgaacaaggcttaaaattattaaatctcagacaaattatatctcctttcttctggccataagactcaacactacaaaaatcatatatggggtttctgatagcaactgttactcaccgttgtcctttcaagttaacctgtgactgtaagttcatgatggaataggtatcattgctgagccctcactacttaggcatggttaagaattttgcctgtccttataaaactaacttctgttttacaaatgagaatggggtcagggaatgtttagtaactttctcaaaatcacacagccagaaaaacacacacacacacacacacatacacacacacacacacactcacatacacaccaagccagggtttgaacccaggtctctctgacaccaggattcttatccatgcctccaaagcttttgggtcttagaatttattccagacattttcattcagtagttcccaattttccaatgatgaagacacctttccaaatgacaaaacatttcataagtcaacatatgaaaagctcagcatagaatctgatacatactgaacacccaagaaatgttaggtgagttgtcaccatagcattgttacaagggaccccaggatagcaattgtactttcaggatgcattgataactatgcttatgaaatagttaatttttatccattataagagttacattcatctgagacaaaaagagtactctgtgtgtataaatataggtatgagggtactatatgtgatttgctgaatacaaaaaatacttgtagcacatatgaatatgcagaccttataaaacacacacacatcccagattaggaactcctcttgaggtcccaacttttcactgagtggtattccaggacattcccttagctgtccccttcctcccatttgtgaacagtgtatccgtaggatgctgcacctccaaatacacatgttatgcatatctttacttaatttcaccactttttaacatatttaagtacttgcctaggcaggaatttaaatagatgcaacagagctacctacataaatcagcccatcactgcaatatataatttctcccataagccaataataattcaattaaataattatcagagctggatggagatgagcaaaataaagagtgactttaaggagagaggtaaagcatttagaatacgagaaacatggagataggaagattatcattagttgcggctctcactgttattttagagactctaatatgtttgctgtgggcatctttatgataatattatgattttagagactctaatatgtttgctgtgggcatctttatgataatattatgtctatttcaattcaaaacaagggattatttttaataaccttttccctaattacaaaagtaacatgattttttaaattaaaaaaacacacaatagtttagggcaaaaagtaatcataatgcccttacccacacattatagagctattaacattttcattaccttcactcagtctcttacccatatatttatttatttttctaactatttatatatccttatatttctgtacttactaaaactggtatcatatgatatataaagcttagttctgcctctttcatttagcatcatatattgagatatttcccattaactattcctcaaaaacataagtaatggcattaaaatattccatctcacaggcttaaagataattatcattgtgattctttactatcatttagaaacatgaacatggcagaagggaacttttctcaagaagaaaaaaaccttttaaaaataacttttatggtgttaaatgtaacttggtaaacagcaaacaaaaggatacatgcaacctcttcaccatgagattaaggaccatatttgccttatctaccatatcttcaaggtctaggagagtccctggtacaatgaatatttatttaaaggaaggaaaatacatatggctaggcattgaagtttgaaggttatacttggagaactgcacacttcaggagtctagaaaacttctcaattccccaatcaccataagctgccactagatgaaatggtgatcaggaagaaaagacagtaaaacattatgttttcctgtcttgtagatggcatttgtgttaagcgtaaactgcttccattttgcagcatgcaaactagctggcaacacagcaaagtcgactgtagtaatttgatccccaaaatgcatgaagaatttatcagatccagacaatgtgggaataaactgacgcatcttcaaccagattttccaatcattcttcctgggacataagcttgggcagggtagaatttccatgattcatcctatcaaatcataaagatgtcatagggctgccaccaatggaccattaactgttgccaggaatattacattcattccttcgactaaaaagatggcaattctaacattcatagagggattttgaacatttacttaaaaataagctttttgctctcaatttagacaaagttcattctagctttgctcttgctttgtttacagttaagttccactttagtcaacaggttaggaatttaggatacctgcttgttttacttatacttgtctcaaattgtagttttaaagcactgctttgccctatcttattaatttacagatttaacagcaaacacaaggccaagatattataaatccccagtgttcagagcagtcaaaaataagtagcaattcctgaagaagggggacatttgtgctgctcttcacactgaagatctttcttgtccttgggctgtgtccaggggctgctaacttctcagaagttaactcagtgacaaaagacattttggtgcctcattagacacaggcaaaggccagaccgtaaactctccagcaggaaagaaagtgcctagctagcggtactggggttgggaggtgctctatagtcaaggggggcatctatgagataaagcaagaaatgtcacaactaggccaggggaaaattcaggctgagaaactgcagaatggtcacagcctcagacaccaactcccttaggaactcaggcccagaaaatgagaaatgaggggcctggtgacttagctgagccccagagtccatttcaccttccatctagtttctacagtatagacatagtcaaatctgatcactcccctcctctgctgaaccccttcaaaggctcctcagcacccaatggatcaagtccaagcatctcaaggcagcacttgaggcctttttgccactctgcccagcctcctttcacaccaccccctttttctcactagtttcagatcactgctgatttcagtgccagtgcatgagagtgtcattcatacccttccttgtcttgaatctgcacccctgctccacctcccatctatttgctcctcctccctctgtctggcctgcttcctgactctattcaggccttcaagatgccttgcttgacctcccagactagactgccctctcctaatatacaccacaactctccttggtcacagtccttattctggaaatgtcctttgagatgtcagccaggccagagggaacaggcaggttgggacattcccttagctgttccctcttagactgtaagctccatgagggtgtagaccatttctgtcaatttattgctttatttcccatgcccagcacactgaggcacatagccagtgctaaggaaatattcactaaataagtggacccataaactgttttgttcctcgttcaaagggattcagaaggaagagcattgggtcttgcccaaagtcctctcacaggtaggtaaaacaagggtctgtctggggacccaggcccaccttggctgctgactcttaattacagagaatagtgtcagtaagcgcaaatagcatcctcctcatttttaacctacagacaagcagcagttccaggcttcagaaaattctcaagtgagttgaccatgaaaaatacaactgaaagtttcataaagtcacagcattcagtcccttcaggcagaggagcattgctttgtggagttgagagaaccacatttcccctcttacttcgcccttgacaacatactacagtataaaaatacatactttacacacaaacaaaccccaagcagaaacctttaaagtacttttatgattagcagacattttcccaatatcatcagtgggagatatgtaaacatatattgtagtaaattaaattgcaagtaaaactcctgatctcatttcttcctcctaactgacaatagttctcttttgtgcaagagcgaactacctgggggctgataaatcagacataaagaagagaacttggcaagggattctagtcagttgctatggagatgtgcatttgtgtttcctttaataaaaattattatccacgggaaaaacaatttgttgagcccatctaattgaaaagaagggaacaggccaaaaatggcagagtttaatatttatgactcaaaatctgcttttaagcctggagaatgcatatataatagggataaactatttttacataatttaattattgcctgatggcatattcttgagggaatccatataggtgtgctttgtactaaatactacattttatgctataaaatgaataatgcatccacactgtaggtgtgggcttttactttgtgcttaagttacactatcaggcattccttaggaaattccacaactgaagactcaaaattgaattaagctaagtaaactgtcaaagccaaaaatctccattaaatgcagaaatcttggataaactgctgggccttttcagtaagtgttattttgtttatgtctcatctttcagatctgcatgttttaaaaactgtaatataaacataaaattatttgaccaactttagtcatccctgatattcaattaacatttaatagaagacaacctgtatctacatttgaatatctaccatatgacaagaaagttacatatactgacacttttaatcttcacagcaaccctacaaattagaagttcctagctccattttacagaagttgaaacaagaaactaaaagcttaaactatactttctgaataggagtgatatcaccaccaagggggcaaaagttggttcttaggggatgaaaacactatagatattacaatagttgctagacttccaaagctaaaccctattccataaaatttatctcattaggtagaacttaaatttaatataatttttcagccagagcaatcatacaagagaaagaaataaagggcatccaaattggtaaagaagaagtcaaactgtcgctgcttgctgatacataactgtatacctggaaaaccctaaagactcatccaaaaacctcctagaactagtaaatgaattcaataaagttttaggatacaaaatcaatgtacacaaatcaggtgccctgctatacaccaacagcaaccaagctgagaatcaaatcaagaactcaaacccttttacaatagctgtgaacaattaaaataaaatacttaggaatatacttaagcaaggaggtgaaagacttctacaaggaaaactacaaaacactgctgaaagaaattacagacagcacaaacaaatggaaacatatcccatgctcatggatgggtagaatcaatatcatgattaattctacacaatagcaatctacaaattcaatgcaattcccatcaaaataccaccagcattcttcacagaagtagaaaaaaaaaatcctaaaattcatgtggaaccaaaaaagaacccacatagccaaagcaagactaagcaaaaagaacaaatccgtaggcattacattacctgaccttcaaactattctatagggccatagtcaccaaaacagcataatactggtataaaaacaggcatatagaccaatggaacagaatagagaacccagaaattaagccaaatacttacggccaactgaactttaacaaaccaaacaaaaacacaaagtggggaaagaacaccctattcaacaaatgttgctgggatatttggcaagtcacatgtagaagaatgaaactggatcctcatctctcaccttatacaaaaatcgactcaagatggatcaaagactcaaatctgaaaccataaacattctagaagataacattggaaaaacctttctagacattggcttaggcaaagacttcatgaccaagaacccaaaagcaaactcaaaaaaaacaaagataaatagatgggacttaattaaactaaaaagcttctgtacaacaaaagtaataaagaaaacagagaacagaataaacagagaactgacagagtaggagaaaaattttcaaaatctatacatctgacaaaggactaatgttaagaatctacaaggaactcatacaaatcagcaggaaaaaacataatcccatcaaaaagtgggctaaggacatgaacagactattttcaaaagaaggtatacaaatggccaacaaatacatgaaaaaaattctcaatatcactaataatcagggaaatgcaaatcaaaaccgcaatgtgataccaccttactctttcaagaatgaccataatcaaaaaatcaaaaaataataaatgttggtgtggacgtggtaaaaaaggaacacttttacactactggtgggaatgtaaattaatacaaccactgtggaaaacagtgtggagattccttaaagaactaaaagtaaatctaccatttgatccagcaatcccactcctgggtatctacccagaggaaaataagtcattacatgaaaaagatacttgccacacgtttatagcggcacaatttgcaattgcaaaaatatggaaccagcccaaatgcccatcaatcaacaagtggatacagaaaatatgatatatatatgtgtgtgtgtgtgtgcaccaaaatatggtatatacatatacatatacacacacacacacacacatgcacatgcacacaccatggaatagtactcagccatgaaaaggaacaaaataatggcatttgcagcaacctggatggaactggagaccattattctaagtgaagcaactcaggaatggaaaaacaaacattctatgttctcattcataagtgggagctaagctgtgaggacacaaaggcataagaatatacaatagactttgcggactttggggaaagggtgggagggatgtgaaggataaaagactacacatgagctacagctcccagcatgagcaacgcagaagacgggtggttactgcatttccaactgaggtaccgggttcatctcactggggatcttcggaaagtgggtgcaggacagtgggtgcggtgcaccgagcatgagccaaagcaaggcgaggcatcacctcacccaggaagtgcaaggggtcagggaattccctttcctagccaaggaaaggggtgacagatggcacctggaaaactgggtcactcccaccctaatactgtgcttttcctatggtcttagcaaacggcacaccaggagattatatcctgtgtctggctcagagggtcctacgcccacggagcctcgctcattgctagcacagcagtctgagatcaaagtgcaagtgggcagagaggctgggggaggggcgcccaccattgctgaggcttgagtaggtaaacaaagcagccaggaagctcgaactgggtggagcccatcccagctcaaggaggcctgcctgcctctgtagactctgcctctgggggcagagcatagccaaacaaaaggcagcacaaacctctgcagacttaaatgtccctgtctgacagcttggaagagagtagtggttctcccagcacgcagcttgacatctgagaacagacagactgcctcctcaagtgggtccctgactcccgagtagcgtaactgggaggcaccccccagtaggggcagactgacacttcatacagccgggtactcctctcagacaaaacttccagaggaacagcaacatctgctgttcagtattcactgttctgcagcctccactgctgatacccaggaaaacggggtctagagtggacctccagcaaactccaacagacctgcagctgaaggtcctgactgctagaaggaaaactaacaaacagaaaggacatccacaccaaaaccccatctgtacgtcaccatcatcaaagaccaaaggtagatagaaccacaaagatggggaaaaaacagagcagaaaaactgtaaattctaaaactcagagcgcctctcctcctccaaaggaatgcagcaacggaacaaagctggacagagaatgactttgacgagttgagagaagaaggcttcagacaatcaaacttctccgagctaaaggaggaagttcgaacccatggcaaagaagttaaaaaccttgaaaaaagattagacgaatggataactagaataaccaatggagagaagcccttaaaggacctgatggagctgaaaactacagcacgagaactacgtgatgaatgcacaagcttcagtagctgattcaataaactggaagaaagggtatcagtgatggaagatcaaatgaatgaaatgaagcatgaagagaagtttagagaaaaaagaataaaaagaaacgaacaaagcctccaagaactatgggactatgtgaaaagaccaaatctacatctgattggtgtacctgaaagtgacggggagaatggaaccaagttggaaaacactctgcaggatattatccaggagaacttccccaatctagcaaggcaggccaacattcacattcaggaattacagagaacgccacaaagatactcctcgagaagagcaactccaagacacataattgtcagattcaccaaagttgaaatgaaggaaaaaatgttaagggcagccagagagaaaggtcatgttacccacaaagggaagcccatcagactaacagctgagctctcggcagaaactctacgagccagaagagagtgggggccaatattcaacattcttaaagaaagaattttcaacccagaatttcatatccagccaaactaagcttcagaagtgaaggagaaataaaatcctttacagacaagcaaatgctgagagatcttgtcatcaccatgcctgccctaaaagagctcctgaaggaagcactaaacatggaaaggaacaaccggtaccagccactgcaaaaacatgccaaattgtaaagaccatcgaggctaggaagaaactgcatcaactaacgagcaaaataacgagctaacatcataatgacaggatcaaattcacacataacaatattaaccttaaaggtaaattggctaaatgctccaattaaaagacacagactggcaaattggataaagagtcaagacccatcagcgtgctgtattcaggaaacccatctcatgtgtagagacacacataggctcaaaataaagggatggaggaagatctaccaagcaaatggaaagcaaaaaaaggcagatgttgcaatcctagtctctgataaaacagactttaaaccaacaaagatcaaaagagacaaagaaggccattacataatggtaaagggatcaattcaacaagaagagctatctatcctaaatatatatgcacccaatacaggagcacccagattcataaagtaagtccttagagacctacaaagagacttagacttccacacaaaaataatgggagagtttgacaccccactgtcaacattagacagatcaatgggacagaaagttaacaaggatatccaggaattgaactcagctctgcaccaagcagacctaatagacacctacagaactctccaccccaaatcaacagaatatacattcttctcaacaccacactgcgcttattccaaaattgaccacatagttggaagtaaagcactcctcagcaagtgtaaaagaaaagaaattaaaacaaactgtctctcagacaacagtgcaatcaaactagaactcaggattaagaaactcactcaaaaccgctcaactacatggaaactgaacaacctgctcctgaatgactactcggtacataacgaaatgaaggcagaaataaagatgttctttgaaaccaacgagaacaaagacacaacataccagaatctctgggacacatttaaagcagtgtgtaaagggaaatttatagcactaaatgcccacaagaaaaagcaggaaagatctaaaattgacaccctaacatcacaattaaaagaactagagaagcaagagcaatcacattcaaaagctagcacaaggcaagaaataactaagatcagagcagaactgaaagtgatagagatacaaaaaacccttcaaaaaatcaatgaatccaggagctgactttttgaaaagatcaacaaaattgatagactgctagtaagactaataaagaagaaaagagagaagatcaaatagatgcaataaaaaatgataaaggggatatcaccaccgatcccacagaaatgcagactaccatcagagaatactacaaacacctctacacaaataaactagaaaatctagaagaaatggataaattcctcgacacatacacccttccgagaccaaaccaggaagaagttgaatctctgaatagaccaataacaggctctgaaattgaagcaataattaatagcttaccaaccaaaaacagtccagaaccagacagattcacagccgaattctaccagaggtataaggaggaactggtaccattccttctgaaactattcccatcaatagaaagagggaatcctccctaactcattttatgaggccagcataatcctgataccaaagcctggcagagacacaacaaaaaaagagaattttagaccaatatccttgaggaacatcgatgcaaaaatcctcagtaaaatactggcaaaccaaatccagcagcacatcaaaaagcttgtccaccatgatcaggtgggcttcatccctgggatgcaaggctggttcaacaaacgcaaatcaataaaaataatccagcatataaacagaaccaaagacaaaaaccacatgattatctcaatagacgcagaaaaggcctttgacaaaattcaacaacacttcatgctaaaaactctcaataaattaggtattgatgggacgtatctcaaaataacaagagctatctatggcaaacccacagccaatatcatactgaaggggcaaaaactggaagcattcccttttaaaactggcacaagacagggatgccctctcaccactcctattcaacatagtgttggaagttctggccagggcaatcagtcaggagaaggaaataaagggtattcaattaggaaaagaggaagtcaaattgtccctgtttgcagatgacatgattgtatatctagaaaaccccattgtctcagcccaaaatctccttaagctgataagcaactttagcaaagtctcaggatacaaaatcaatgtgcaaaaatcacaagcattcttatacaccaataacagacaaacagagagccaaatcatgagtgaactcccattcacaattgctccaaagagaataatacctaggaatccaacttacaagggatgtgaaggacctcttcaaggagaactacaaaccactgctcgacaaaataaaagaggatacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaacaaaaaaacagcctgcattgccaagtcaatcctaagccaaaagaacaaagctggaggcatcacgctacctgacttcaaactatgctacaaggctacagtaaccaaaacagcatggtactggtatcaaaacagatttatagaccaatggaacagaacagagccctcagaaataatgccacgtatctacaactatctgatctttgacaaacctgacaaaaacaggaaatggggaaaggattccctatttaataaatggtgctgggaaaactggctagccatatgtagaaagctgaaactggatcccttccttacaccttatacaaaaattaattcaagatggattaaagacttacatgttagacctgaaaccataaaaaccctagaagaaaacctaggcaataccattcaggacataggcatgggcaaggacttcacatctaaaacatcaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggtgaaggacatgaacagacacttctcaaaaggagacatttatgcagccaaaagacacatgaaaaaatgctcatcatcactggccatcagagaaatgcaaatcaaaaccacaatgagataccatctcacaccagttagaatggcgatcattaaaaagtcagggaacaacaggtgctaaagaggatgtggagaaataggaacacttttacactgttggtgggactgtaaactagttcaaccattgtagaagtcagagtggcaatccctcagggatctagaactagaaataccatttgacccagccatcccattactgggtatatacctaaaggattataaatcatgctgctataaagacacatgcacacgtaggtttattgcggcactattacaatagcaaagacttggaaccaacccaaatgtccaacaatgatagactggattaagaaaatgtggcacatatacaccatggaatacgatgcagccataaaaaatgatgagttcatgtcctttgtagggacatggatgaagctggaaaccatcattctcagcaaactatcgcaaggacaaaaaaccaaacgccgcgtgttctcactcataggtgggaactgaacaatgagaacacatggacacaggaaggggaacatcacacaccggggcctgttgtggggtggtttggggggagggatagcatcaggagatatacctaatgtaaatgacgagttaatgggtgcagcacaccaacatggcacatgcatacatatgtaacaaacctgcaagttgtgcacatgtaccctaaaacttaaagtataataaataaaataaaattgtaaaaaaagactacacattgggtaccgtgtacactgcttgggtgatggatgcaccagaatctcagaaatcaccactaaagaacttactcatgtaaccaaacaccacctgctcccctgaaacctattgaaatttaagaaaataaaataaatttaataaaatttttcttcttaggtgggacaataatgaaaaagaagactaagaaactctggtctaacctccagcaagtgatggagccattcatttacttcttaaacagacatctggggaatgtctgtgggctacacactgtgcaggggctaggtgtatagtggtgaacaaaaccaatatgtatcctgagtttcccaaagcttctagccccaagagggacacaaacgtaaatcaaataaccacacaagcaaagatactattgaaaatcatgaagactgctctgatagaaaaagagagtactgagaggtcagaaactgcctctttacaggtgcgactttaggctgagaattgaaggacaagaaggctcaagtgcgaaaaaaaaaaaaaaaaagaaatgggaaagagtgttgggctcagagaacccaccagaaagacatgctgccttggaaaccaaggaagtaagagaggagctgctccctacttccagagatattattacttcaatggcttagtggccaaagactgatttccaggttcaaaccacaactttactcctgataagtttgggcaatttttttcatctcgctgggcctcccattttggcattcataaaatacagataccattgcccacacgtggctgttagggagattaaaatgaaaattgcggaaagtgcattgcatatgataaaagcataataaattggttgtctacaatagttatcattatcataaatagattaatacgacaaacaaaagcagatgcctctgaatggcacaaagactgggtctggcctccagtcacagtgtcagtaattgccttctgtttatcccctacaatatcttacactgtgattatagggctttatgcagataagaccagcagcacacacagggacttctgaatcatgattatttctatgtgttataattagacactatcctcaggttctgttacgtcatgccattctgcatttcccaaaagattttccaatattctgatgccatgaaatgctttattaaaaaaacaggttacacagaaaaatggttttggaaacgctgcctacaatatgggtctgctgggttttggaaacactgcctacaatcagggtttcggttgcaagccaaaaattggctgactgaagcagaaatgtattgaaaggttacagggcagctcacaggatcattgagagggatggagaatcaggctgagatgtctctcagtcgactcacggcccaaagcacaacataaagctgtctcatcagtcagcaatgccactgtagctggcgtgcctgtcacaaccatctccagcactgaccactgaacagtgccgctggctccactgcaattgtccctggagcctgtgtgcttcagacttcaccactgccacagagaatatcactagctgctgtccaaatttctagactaacacatctgattggcaaagccaaggtcacgtgctcaagggatggttgtctgggaagttgggaagtacacatctggtatttcctagttatttggtgggagtcaagttctgcttcctactaagactcttaaggtcgagaatcctctccaccaactatagaaaggaggttctgatactgaaaaaaagaaaaaaaagatgaatgtgtattatatcaatgggctccaaatgttttgatcaggtactcttatcaatgaaaataattgagcatgcacccttagtatatgtgcacatatttctaagttaaatatacataatactctaatactatgatagatgaagcaacctgatagaagtcacacacataaacaaacatctgttagagacacacagtgaagtaaggaatttcaaaatctataatctaatttgaaaattgaaaattttcaaattagattatagatttttacagctattactatgattctctttttctctctgctttttgtcaggctaacattaggtactgactaagcattagcaagtgtcaataatgcagaagccacccacttctgcaaaactgggaattgaattcaaacaatgttattcttctggttttggttatagaattcaagagatattatttcagagtctacaaaagttgtcatctcaccaaaaaaaaaaaaaaagtaattcttgctcattgactttatttatgcagcattccctgtagaataataatagatgctttacacagagtcctgcacagcaatcttgcaacctcctatagaagagaacactgagggcaggttatgaacttgcccaaagccacactcaattccaaggtgtactacctacctccatgtaaacatcctgtcatttctgcataaaatctaaaaagcagccgggcacagtggctcacgcctgtaatcccagcactttgggaggccgaggcgggtggatcacgaggtcaggagatcgagaccatcctggctaactcagtgaaaccccgtctctactaaaaatacaaaaaatttgcagagtgtggtagtgggcgcctgtagtcccagctccttgggaggctgaggcaggagaatggtgtgaacccaggaggcggagtgagcagagatcgtgccactgcactccagcctgggcgacagagcaagactccgtctcaaaacaaaaaaaaaaatctaaaaagcatttcaaaattcctgaaacaatctacacaatagtacaatgagaagctctgtcatcttctgattaaaaaataaaaactgaggatacaagaagtaattgatgactcagataattcactcatcagtgtaagaagagataccattttactgtcaggtactgtcaagagtatattaaaatgtttttagtaatcaaaggcaatgctactagcaacataggactccagatactgaaaattactgagggtactacatccatgtgaaaattattggtgctgagaaaggcagataatatgagatatactggttggaaggacagagcagattaaagttatagattatatcttctgtttgtgagaaatgtccacaacatacagcttgaacccaggttctctaagccacatccacactacattcctcttagtttcccatgcaaacaatttctgtttttccctgacctgctgcagagaatgtcccccttcatggaacaccatggacacaccaccaccaccacctcctgctcccccatcatccattggccaactgttattcttctctcaattctcaactacaacaccatttgcttggtgaggccttgtctgactgtttaaaataagcttgggtgctcttgcgtaccactgcccaaaattttctgtcttccccctttctgaaccatctactcataagtacttatctaatttttggctcccctagaatggaaggtcagagtacagtcaccatgtcgatcttgagcaatgaatatactccacacctcccccatagtaaatgctcaacaaatattgaatagatgaatgaatgataaacaaatgctatacaaccgctatagctagatgcaaaatacatcatagtcatcttgtttctatgggtcacaaaaccatacaaaagcctcctggccacgacatgtgaaatggaaaaaaggagacctctagacagactccctcaagcctggcagagcttcaggcaatgcctgtatctttcctccatcctgggaacaagcagttcccttcgttggcttcgtattgagaccatcatacttgtctcctccctctatctgctcagggagcagccatccccagctgggtgcctcttctcatgacaggaatgaacacagactgtgccaccacagaccaagctcagagagaagaatttaaccacttccctcccaaaaacagggcagctgaccatgtctgtagacaaatgtagctctgtggaatctggactgtcctcatctcttcatgttccatttttcaaaggaatctttgtttctaaaatgaacattttgaaaaccaggaatagagcatccaagtaagtcagtatgaatgatcccactggaggagattcctttgctggaagagcaaagcttgctggcattgtggtgggacctctgttaaccactgtccccatttcacaccacactgattgaattatgcctcttagatggaaaaatattttccccaaaaccaagatggcacataaattgaaggcaacatacgcaagaaagtggaagccacatttgtcaaatgcagagaggatgaattaataaaaggacaacaaactcaaaggctaccaaagaaaaatggcaaaaaaaaaaaaaaaaaaaaaatgacaaccattttaagtctagttgacttagcaggataaccacactatttctgctgacactttagccctgcaatgtatataactctccccttttttaaaatccctgcttcttggcacctataccctgactactgaacctctctttggcactctctgtagtgactaattaggacccagccctagtaataaagcagggggccaacattttatcttaggatccttattctctgagtgactatttctatgctaaaaattacttgcagtattttcctctccactaagtacatttttaaaatacattctacaaaacattatctccacatgttaaaagctgctaattctacatgttaattcaatcacatctttcaatgatatattcttacataacttcaagtgaataatatgtaaagagatatccatagcaacttagaatataaacaaaaaatgacatatagattttaaagtttgtgtatgtccaccatctgtcaattagtttcactaagtaatatattcatatactcacagagttatgtataatcatatttttagattcagatcagcaagaatgctcaagtttagcacagccaaaggctggctagagtgtggaaaagtcagccctctcatgctctgtgggtggatgtcttaagcagcacaactcatttataagggaatgtggtaaaattttaattaattgtcccaccaatcccactactaggaatttgtccagtgaattatttacacaaggaccttagtgtttacgttaaaggatgtctatagcagcattattcagggcacacacaaaaaaaccaaaatgtccaaatccagaataaagaggaaataagaaagataaaaatgaccaggagttcaagctacagcttgagtggcaggggtgaggggtttttcatggtgatggaaatagagatggcgggggtaaaaggaacacagagcaggtgaggagagtacttgtttattattgtaagggaacagtgccacagtctatgcatcctttgtcatggcatatgacaaatttaactatagaactttgagcaactctgaaattattattgtggctgcaagacagacacaccatgcaaacactgaaacacgggtcaaggctttccaagaaaaacacccacacacgggttttaatatgcaagaatacccacagttacaaaccaaacatgcatgtattctacatacagacaactgcacattattctcttctacattccacttcctgggaggccccaagagatactaatcaaaataagtaaatactaataaaaatcagagaaactgaatacccattatgagccaggaacatgctaagggatttacatgaccaccaacacaatgttggcaggtgacccagagttaactttctcactgggagtgttatctcctatcaactcttttcttggcctctgataagaggggacctgctcccattcctcatatacctcctgcctattcccttgttccccctgtccatgtgtcctcgggcaagtcctttctcatcaacacccagctcttctcatattctcctgctctcactcttgccttctaccctattcctaggtttctttagtaaaatctctcaagattttctccactcccaccatgtgccccctccttttttccccatttgttaactgtttcaaaaggatccctgaaggtatcagcacactactaagggggaaaaaatgaaaaaagggggaaaaaagcattatctgacatctcaaagctggcctggcactcacaccaggccatgataatccacaattggacataatagttctcacagaacacaacttcagacaaggttacactgagaccatgataaggccacatcataactttgtctaagcgcagacaataatgtcactgtgccacccacaaaataccaaacacttccttcacttggctaaaataagtgactgcttcttatttaccaatgaaaattttatctttgctctcttgtcttcatcatagataacatttattgagatacccaatcatagaattgtgcccaatttctaatctgcagcaaaatctcacttctttagacccttgcctgaatcacccaacccaaaccgaaatcctaaattaggcttttgtctaacaccttcttactaaggctctgcattgatgcatgttctccctcattacaacaagtgataaaaccaatataatcaacaacaggtgtgttcctggtactctgtgtttaggtagcattgacactaacatcaaagggaaaggaagtcctatgttctgaagaaaaataggatgtcatcctattgatgcttccagcccaccaatgaccaggcaggcaaacactcatgcccagctcacagggatccagctggaacttcacatcctcagaaccaacaatctgccttcctaagcactagcatttatggcaatcagaactgcgcctcatgcacttgtgtcatctttctgtttattgaagtactatcgcgacagagatgctttctactattctactatttttccagtgaaaatatgtaatatttcagccagtgaaaagaactcggatcctaagcaaatgaaatctgttatttgctccaagatacaaattacctacctacaaaagatttaatgacctatatttcacttataattgttcctatgagcaatcgagtctcatttggtaacttagagaaaatacttccagcccacatgcaagaagactgcttctgtttgattgtttttaattaatcctctgcaaggaaccgagttttgtttgccatcatctccccagcacctagcaccatgcctagtggtgctagaaatataacagaggctcaaaatatttgctaacgttctgtagttgtacaaaattaaaagtgcacgaaaagtggttattaaaagacagggaagatactcaggaggctgaggccggagaaaggcctgagtccaggagttcaaaactgcagtgtgctatgacattgtcaccgcactccagcctgggcaacagagtgagacctcatctctctctgtctctctctctatatatatacataaaaagacaggaaagagatgtgaaaaggtgaagttttagaggtatgatgagatagtacaaggcactacgggaatgacaaatgggtctccaccctactcccaggctacactctcaactggtggccagggagaaagagcatataaacactcctgtctacaagtcctagactcactagctctcttctccgtcttaactcctaacatccttcttggcaacctccaccttcctacgacagactcatccaaactccctgggcctcttattttttacccttcttctccaataatgttttaatttgctgtattgtagatgcccatgattactccaaagacattggcagcacccaaaactgccccttgtttaaaattcttatgcaaacacacttctctttaaactcactttacctccagcttacttgctcaactacctccacctcagtgtgctctgtaacctacagatcccaccacattctcatcagctctccctaatcattcccccactggccctgcttggattccaagtcactcatcataaccactcctttgcaaataccctcacatcctttcctcctcttgtcccatagaattcacctccattcttaatgttaaatacagatacagtgtgttctgttacaagatctgttttcataaaaccaatgagctcaaatgtaattggtgaacaggggaatgaattcactataatgtggaagttgcatcggttcctgggcagtttttctaaagcaatggggagtaaggtataggagcacactgacagcctccaacaggaaagaaagcaaacagctttcagttcggctaaaatcctctctgctctttttttttttttaattaaaaaaaaaaatccctttagcatgtgaaggtccctccctacaagggcataccccaggtttactggatgtcacgttgtaccaaattgtacttctccctgtgccctcccgaacagaagcccccctgactccgctttgcttccatctgcactgcctctgcacccaaaaactagttttccaccctactctttcttgtgcctttgtattatctcatgagactgacagcaccatgagctggtgaggatgtgacactagaacatctacgtggtgctggtgggaatgcaaatcaggaaaaccactgggaaaacgatttagcagtatctaccaaactactttgtgccccagaaattccacccaagagaaatgagcgaagatgtccaccaaaagatacgcacaagaatgctcatagcagcactacatagaataaacaaaagcaggaaacaactacatcatcaacaggggactggataagcaagttgtggtatattcacataatgggaaattgcacaataataaaacataagttacagatatggataacaacatgaaagaatttcatagacatgaccatgagagaagaagtcaaacacaaaagtagatacaatagaaatccatgtatgtgaacctcaagggctggcagaagagtgattacctcgaggagacaatactgatggggaggggcatagtggtctgctggggacaggaaacttcctatattttcatctgagtggtgatgatataaatgtaaatttttttattcgtcatttctaactgtggtaaaatatacataatatttaccatctcaaccatttttccctgtagatttcagtggaataagtacattcactttgttgtgcaaccgtcaccaccatccatctccggaacttcccaaattgaaattccatgttcattaaacaataattctcccttctctcatgtcctacccttgtaccagctattggcaaccatcattctacttcctgtctctatgaatctgactgctctaagtacttcatataagcagaatcatacagtatttgcctttgtgtgatttcacttagcataatgtccttaagtttcatccatgtctagcttctgttggaacttccttccattttaagtctgaataatattccattttatgtctatatcaccttttgttttgccattcaattgctgatgcatgcctcagttgcatctacctgttggctactgtaaatattgctgctatgcacatggtgtacaagtatctgagtttctgctttcagttctttggtgtatgtacccagagggtataaaaattactttaattcatcaaactgtatgtttaagatgtgtatactttactgatttgtacgttatgcatttttaaaagtgtaaaataactaaagagcaatgacaacaacaaaaatatcccccaaaatatcttccagctgcacttagatgcctacttgggccgcctttatggctttttgggggatggggtagggcagggaggggttccagttcatgtttttgttaatgctttggttataatgggtaagagtccataccagtcctatttttcccacaagccccaatcctaatattaatgcataattttacagaatgcttttttccagaacttcacgtactttgttataatatttaaaatatacccaacatatacttatttggcatatatttaccaagtgccaggcattattcctatttattgaggatacagcagtgaacaaaacagacaaaaaggccttgccttttaagggcttgcacactaatagataaatgtttttaataggtattcatatgttatttatcaacagttcccccatggcatataaactccatgagggcaagttctgtcctatgtccactcctaagcacagtgcattatacatagaaggtgcttctaccattcttagagctatcattcttaaagcacttttggccaacctctggatttcacagataaaggcagtttcagagaaatgataatagcagcccaagtcacactgttaataaatatccaaccggaatggaactaggactctttcatacagaacaggacaaactgtaagagctaagggttcttagatatgatacttaagtacaaagtctgaaggggttttagtctttgctcagagaatcattcaagaagaaaaacagtaacaagctaaagcaatcaaagataatgaggcagtccttgccattttttccagaaggcttctagtcttattatgaggcttattaattacttaagcagaagacatgatgtggattgagacatctctaataataaatgaaaaatgagagtaaattttattgtgcaaggaattgaaaacattctaactagtacatggaattaggaacattctgaggctcagctctaaaaactctataggttagatcattttctcctttggcaaatatctagtctttttttttttttttttttttttttttgagatggagtctcgctctgtcgctcaggctggggtacagtggcatgatctcagctcacctccgccttctggggtcaagcaattctcctgcctcagcctcctgattagctgggattacaggcgcctgccaccacacccggctaaattttgtatttttagtagagacagggtttcaccatattggccaggctggtcttgaactcctgacctcagataatccgccagcctcggcctcccaaagtgctgggattacaggcatgagcaaccatgcctggccaaatatccagtcttacaatgatgttcgttaataatttaagcagaagacataatgctgattaagacatctctgatgataaatagaaaatgagaatatacttcatcgttcttaaatagcatccatcacactattgagccttaaatttagtaagtaaaataatttatcaaacccattatttgaaaaggtgataaagccaatttcaaaaccagtagtaaataaagcaggactgcatccatgtatcacccattaaattgggggttttttgtttgttttttgtaaagatggggtcttgtcatcttgcccaggttgatctagaactcctgggctcaagcactcttcttgtctcagcctaccaaagtgctgggattacagacatgagccgccacagttggcctaaagtggttttaaaagcattcaaattattataaatagggtattcccttagaattcttgaattcaaagtcattgctcaggaaaaaaaaaagaattttataatttatgtattgcagaattatgtatgtaagaaaacattgccttcttaatagctagagctaaatgaaacatttgtgctttttggaagcattttattgttagagtaggagaaaaagataaactcaaaattgtgtcaaaaaatgaaaacagtataaatggcattcacatgttctttgccacttctctcagtatctccaggacacacattacctcttatacatattattgaaatagtttttaggcctatttcacccaagtgataagaaaattaaaaataggattaaaatatgcatcaggtgctgcctaagggcaaagtatcatgacatggtgttttatcttctttcaatcctcacaataaccctaagaagtaggaactattattactcccattttacagatatggaaactgaggcttagacctattttagttgaaattcaaactaggacagtctgattccagggctcatgcctttaagcattataatatatacatgtatcatagcttctgctctgacgccagattaagctcgctaaactgtggtgctccaataccctggatgactccttctgcattaagaaaagaattattttaccaagcattcaaaaccctccctgccctgaccccaaaacctatctttgaaggccaatctcttgcacttctatcattgactgagcattcttttctcaatatacaaaagactttccaagcctttcacctgtgtacacactcttctctcaggaatgcccttccaattcatcttttccagtcaaatcgcaacacattatctgagacctggctcagaagccaccacctgccattgtggcattccctcaaccaactatgcatgtggggatagcatctagactggctaccttgtatgcaaacattacaattagaactccatgacagttcatgatgtaagtatacacaatgcattataaattacagttgttgaacttgagacaattatacagaggttagagttatgatacatttatctgcactgaacatattcctcttttttgagccatagagaaccaggtcatgcctgatagcctgaatttcagcagctaagcactaccgtcagctgatctcttcatgaaaaataatattaaaattgtcaatagtgacttcactaacagacccacagcctagttactgagcatcagaccatttctctcatagatcccctagataagaaaggaaaatcattctaaataaattaactcttcagttgcctccacacaaaatgaggtaagcaataacaaactagaaaaaaaaatctttatagaatgtaagacctagacatagttttttttttttcttttttgaaacaaagtcttgccctgttgcccaggctggagtgcagtggcatgatcatagctcaccatagtctcaaacttcagtgtataattgatcctcctgcctcagcctcccaagcagctgggactacaggcatgcaccaccactcctggcttttttttttttttttttgacagagctggggtctctgtttcccaggctagtcttgaactcctggcctcaaggaatcctcctgcctcagtctcccaaagtgctgggattatggatgtaagccaccatgcctggcctatattttgttaattataaaccaaaacaatccaaaataagaaacaaaaatccactctaaaataaaaataaatatataaataaataatcctctcttacctagatacattagatcaattcaaggagaatagttttgggacagtctcccaaaccaagcacggtgcctctctaagggctttttcctaacaatctataattttccttcttttatctttcagaaaacatccttgtgtgtgctccagtagcctccattccaggtctacgcatgattatctgggtctatgaatgcctgggacttcatccttgtgctacaagtcacaatctcaacaggacacatacagagataaaatgctcaaccagcaacccaaagaaaaaactgaaagtgaagtggccagggccatgatgttgctctgctatcctctatcacacatcatcagaaataccctcacctctgtagtccttgattcactcccaatttaaaatgtttccatggattcccactgtatttacatccaagacctactccaccacactctttgctgcaccttctacacactagaattcttcagttcctcaagagcaccagggccttctgcctcagaccttcaaacatgcccttcctcattatctcccgtttccgaataattctcattcagccttcagagctcaacccaaaaatcacttcctcgaaaaaaccctcctgaacaccccttcagatatgcattggcactttctttttataacaccacgtatgcaactaaatacaactaaatacttgtttatctggttgtttaatgtctgtctccatggaacacagctctctgagggtatggactttaatggggtttactggctgttaaattcccagtgcctgtagatgctcaatcaatattgccaaatggatgggtttccctgtcagaccctaagtcataatttctgtcatggaaaataaagtcaacatttgtaaacagacttcattttggtcaccattgtattaatttcctattgctgctgttacaaattaccataaacttaaaaattaccataaatttaacagcttacaacaacacaagtccaggcacagtggctcacgcctataatcccagcactttgggaggccaaggcgggcagatcacctgaggtcaggagtttgagaccagcctggccaacatggtgaaaccccatctctactaaaaatacaaaattaaatctactaaaaatacaaaaattagccgggagtggtggcaggtgcctataatcccagctactccagaggctgatgcaggagaattgcttgaccccaggagctggaggttgcagtaagccaagatcacaagactccgtctcaacaaccaaaaaaaaaaaaaaacatttttgctctcctatgtttctggagataacaagtccaaaatgggtctcactaggttataagcaaagtgtcaacagggctgcattccttgtgaaggctctagaggttaatctgttcctttgccttccccaccttctagaggtggcccgtattgcttggctcatgggcatcgaccatcttcaaagccagcaatcacatcaatctgacctctgtctctaccatcacatctccttctctgactccaaccctcttgcctcactcttcacttttaaggaaccctgtaattacattgggctcacttgtataatctaggatagtctcctcatcttacaatctttaattaaaccacacccacaagatcctattgtcatgtaaaataacataatcacaggttttggagatccagatgtcctcatctttagggagatacgcctgaaagtgttttatttaatgtgcctctttccttacaggaatcctaataacaacaacaataataggaatgataatctactacaattctatatcttagagaatcactataaaaactcaagtacaggcaagacaaagagtagcagcatgaaataaactcaattcactcttttcttgaaatgatttctcaggtcctgtacatctcagatgattcactcaatccaaagcaactgccttaatagccaaaaaatggaatgtagtaaaatggcacatacaactaaagaggatggcttttcccttcagtgggtttttttataagttcaaatgggtaattggagagctgggaatttaattccattagattttataagttgtataacaacatcccaaaaatgcaattccattagataaactattactaaaggcaaaggtcttggcccacagttcttaacattttttagaccatgaaccctggaatttctgggacattcagatggttaatgggaattgtcttagtacattttgcatggttataacagaatatcagagactgggtaatttataatgaacagaaatttatttatcctggttctggagactggaaagtccaagattgaggggccagcatctggtgagagccttcttgctgcattgtccaaaggcagaagggccgagaggatgagacaaagagatcaaagggggaaggtgagataaagagaccaaactcatccttttataagaaactcctgtgagaacagcattaatctacacataaggacagtgtccccactaaccaaacacctcccattagactacacctcccaacatcaccacactgggaatcaagtttccaacacataaatttagggggacacattcaaaccatagcaggtattaagatagagtggtttcagttgggatacagacatcatgacaagtattagcagcaacagcatttttccctatagccttgaaacaatcaatgcttcccgatctctttagggtttatggtagaacaactgctttcacaaagagccttccctgtccagagtcctttggtctgtacaacctctccccctacccccaatcccacttttaatttatttttaccttatgcatacaacaatcattcaacaactatcactgaatacctactcaattccaagctgaaaactgagatgtaacagtaaacaagataggtatggcccctgtccacatgaagctttcatttctactgagaacacaaaagaaataattacacaaacagttgtaatagtgatatttgctacttgccatgtagaactcagagtgaagtcacaaaatgaatacacatggacaaaatgaatacacatgggcaaggcaaaatttggcctagcattgtagatagttgccaatgcttttttgaaaaataagatttcacaataaaataagagttttcttgtactctttttaaaaattcattggaactgagtagcagctgcccctttttgatagggcatatggtttctggttttccaccattctcaacactcccttctgtctccctgaccgagtccaagttccagaccccatttttcatcccatttatgctgctatttttcccatagacctgcaaagtccaatgcagtagccactaaccacaaatgactatttaaatttaaattttacataattaaatgtgaaatataattaaaagttcaggtccttatttgcaccagccacattttaagtactaatagccacatgtggctagcggctaccataatggatcaggcagatatagagcacttccatcatcacagaaagttctgctgtcaacaatccctttcattttttacatcattcacttgaatcctacagacatatcagtttgaaagccctggtaaataacaatataaaattatttaagtgggaggatcaaattggatctgggaattcaaagaacactctcctgtggaagtgaccagaaaggtgggatctgaaagatgtgataatcttagttgattgacagtagttggggaaaaagttattcaggcaacaaaaacaatgtacaagggaacttacagtggaaattttgcttatagaaatatttcctgatgatcttagctcacttcatctctccttattaaaaaaaaattaaatccttggtcagcacatagctgagcaatagagggctgcatatagatttggagcttcaaataacatttcgatacattttttttttcaagtatcacttgagaaaccatatccactcgaagaaaatcaactttttttcctctccacttcagcatgatagtttccgatcctgagaccatccaggccctgaatgtgaaggccatctgctgagcaggccatttccctgggacagcaagtgctcttcttgagtggatttcaccaaattgcttttcctttctaaaggagattgacttatttgtagaggagggcatcccatccttggggcttttcgagaacttgtatcttcacagaaaacggtgtgctttgagagttgtttcagatcctaggctgctgaaggccaaggttttgctaacagcttctcaagcactggggtctatttattatattgaggtattttgggctccttgatggtaataatatgaaagcaggtccaatctatgcactaagaggcaccttgcttttctacttccatagaactaacatctactaagtgacaaactatttccaaggcttcactagttttgctgggaatagagagaaaacagatacctgagtattgccctaaaaaattcacagcttagaggtaaagccaacataagcacaattcctccaatcgatgcaaaaatagacatacgtaacaagtgttgaatgaacaaccaacacgaatgttggtaaaaacatcaggtccagccaacatgaaattacagaagaccatctctcatacagttcctccactgacctctcgcaggacatccagctgcagaatttgaggcaaaaacagacccaacttgccacttttcagcctaagcccttctgcccactctcctctctcagatcctttagaccaataagatttaagattttacttccattcacagactccccaacccacaaaatacctgcctgcctgtgcctaaggctgcattttatacttcattaacctagtatttttccagcatcagtggagatctccatcatgccaccagatgacggcgtcacccttcctggactccacatgtgtttactgcaagaagaaactaaaatcttccatactcaagcccttccagttggcctaatagttgcttatactttcatctttactatgaagcaactctgttaaaaaaattatttttcaggtgccaccatggatatatccaccctttgatcagggagaaaagcatatgtgaaattgagaaaggacacgttttccttttcctgggcaggttttggggatgtcagtcactgtaaaaatcttttcttgggaatgccgtccacatctgcaaactgttcctgcaaggtctatgtagaaatgcatttaagaacatagtttttcttaagcaatcctctctggaaaacaccaacctggcctcctcagctgaactataaagtcacattgctttctttttttttctatgacaggacagaaggaagtgattcacacacctgaattccctaagaaacagacattttcacacaggaaggtgttttgatagcttttctttctttggaagtcacgacgtacatgtgagttttaagggttccttattcagcagggaaagaaaacctaagatgggatgataacaatgtgaattataccctatttaaatgatttctgcctttctattttttccttttttttttttttgcactttatcagaagcaagcatgattcaaattataatattggcagaacaaatttgtagtttctaaagaagatattgtcacatctgcaccactattgagctgcataatgttgcccaagctcctcaatctctcttagacctaggccagagggactcttgtcctgggccatggactttagagggcacatgacaaaccccaaaatgcagggttttttcttttcaatcttaaatagaagttttgtttgttttcttaatttaataactgactaagccaatgggagggactcacctgaacttggactccagaccggagggtgctgaactgagagcccatgagagaatgaaccacagcctctgtccttggaaaccaagacgaaataggtgtttagtgttgaagtagacaggatcccccagataactctgttgtctcccttctccttgttcagaggatgtaatctgagaggcacttagaacccctggaaggcctgagtcagacaagtggggcctggaagtgaagaatctgccttacttgcctccctggggagcttgagcaggtcattaccacctgctcaggtttggtgagcccaggagtcttgggcgtggttccaactcccacctagccctgccccagcagatcagtgctgccacacagcctctttagtctgcagggctggcccaggggagactgaagctccaggcagagggctgcagggcccaggagagaaggcaggcatagcttaattggaccattggcatacttagatatttggtctgcgggtctctgttagcacttctccaggccccagcaatgctagagcaacttgcttctagttccttctctaaaaataacaggactcaattaaattgctctacagtttggacctgctctacaaaatcattatattttcatttaagtaccttaagataaagtgacataaaaattgcaattcaagatgtcagaaaaaaataataaactaaaatttatttttccagagttatttcaagaagaaagctttaaatgaattacagcttctggcttgccctttcctacctctcaggttgcatgccctataaaaaggatgtcattaagtaaaactatggtttgaaatgcataaggatccgcacacataaaataccacaaatactacactgtaaaattctccatgtggcataagaatcacagtttatcacactctaatgatcaactggcaattaatccttaaccacctcccagcactgaagatcctttctaaaatatacaaagggaaaaaattatgaagagattaccctaagactcagcatccaaacaataactttataaagaataaacgagccaggcatggtggctcatgcctgtaatcctagcactttcggaggccgaggcgggcaggttgcctgagctcaggagtttgcgaccagcgtgggcaacatggtgaaaccctgtcacaaaaaattagccaggcatggtggcatgcgcctgttgtcccagctactctggaggctaaggcaggagaattgcttgaacccaggtggcagaggttgcagtgggccgagatcccaccactgcactccagcctgggcgacagagtgagtctctgtctgaaaaaataaaataaaataaaaagaagataaaaagaataaacgaaagccatgctaaaagcagataaagactagaaacactgagaagtatttactattattacttgggagcattaacttagaagtacctagagatgtcaactgtgaaatactaatctgagttttaatttttctcatttttatactaattacaaagacagatgtgcttactacgcgcactgcttaaacaagtatagtaaaagaaacagctttcccccttctgatcggaggcataaataatatttctgtagtatgttctattcccatatatcacagaactggctgaaatgtatctctggcttccataaatcataagtacagttaagcagaacctcctcctccaatgtagaaaacaaacatagagcaatgaaatctagagttacacaatatttgagtgtgagtttcttcatagtccattttaattgatttatacagacaggaaagagggggaacattaaaccttttacaaaccttcccgagtttgcctaattaggccagtcctgcataaagagcttcatagttttggaaaatccaagagcaatgaaataaaaatgagataaattaggggaaaacacacatattctaacacctgttcttaaatcctgtgcttctaacaaagggaaagttataagtaatggacacgaagaacaatgaccagcttcttcaccaggccacagaattgtatctctgaaatttcaatccacattttacctttaagaaggaaatctgtgaaacaagccaaaaccatcaaaagtgtacatgaaaagtcatgcttgatgggagaagtttatttaacagaacattaactgagatgtgtaaaataactaatctcagtcaggactgaagatagtaattttttaaaaaagcattttcaatttttgtttaaaaatgtgctcagaatcttcatgtctagtaagttgctgagtaaatgtaaatgtaaaaactaaaatacctaaagtaaatgaccctgtttaaaaaaatatttaaggcagtgctaaatcatctaccatatttcttctgaatttaagacaccaacaattataagaagcatcttaatttatacccacagagaaaagaaaatcttgtaatagcaccaccaactgtgagatgcagtccaatttcagagacacaaaaatatgcttaaaaatgagtcatttaaatatggaaaacatatccagctattaaacttgaaaaagctagaataaacatttgtgtaaaacgaccacttagcaaatacttgtagaataaatggaaaaacgaatgactttacaaacaactttctttttaaaatttttttatatattcaggggtacatgtgcaggttggttacgtggatatatcgtgtgatgctgaggtttgggtttccattgtacccatcacacaaattgtgaactctatatccaataggtaatttttcagtcctcactctcctttcctctcccccattttggagtccctagtgtctactgttaccctctgaatgtgtacatatacccattgtttagctcccacttacaattaagagatcacacaatatttgattttctgtttctgagttacttcacttaggataatggcatccagctccatccatattgctgtgaaagacatgaaaaggactgatatccagaatctacaaagaactcaactcaacaagaaaaaacaaaaaccccattaaagagtgggaaaaggacctgaacagacatttctcaaaagaagacgcacaagcagctaacaaacacatgaaaaaaatgctcaacatcactaattatcagagaaatgcaaattaaaaccacaacaagatatcatctcacaccagtcagaatagctatcattaaaaagtcaaaaaacaacagatgtcagtgaggctgtggagaaaaggtacgccttatacactgttggtaggaatgtaaatttataacagctctatggaaaacagtgcggagatttctcaaagaactaaaaataaaactaccattcaacccagcaaatctactacagaatatcaacccaaacaaacaactttcttgatagaaaattggaataaggaaaatttctgtatatatgatcatagagataagatcatagatcatagagctatacatatgatcatagaaacagatagttcccccttcaccgagtctttcccttactactttggaccacctttctcttccatctcagagttcctacaaatgttggcataaaaaagcacacactctaacactagttttacatgcaaacacatatccacatacatacacactcacctacatgctagagcaggggtcaactaatgatgacatatgggttaaatgccagctgccagttttgtaaataaagctgtatttgaacaaattcatgctcacttgtttatgtattttctatggctgctgtttccatgctacaatggcagcattaaataattacaagagacagaatggccctcaaagcctgcagtatttatcatctggccgtttaagaaaaagtttgctgaacaattcacaattgcaaaaatatggaaccaacctaaatgcccatcaaccaacaaatggataaagaaaatgtggtatatgcacaccatggaatactactcagccataaaacggaacaaaataatggcctttgcagcaacttggatggaggccatttttctaagtgaagtaactcaggaatggaaaaccaaataccaaatgttctcatttataagtgggaggtaagctatgaggacatacaagcataagaatgatataatggactttggggacttggggaaggatggaaggcggaagagataaaagactacatattgggtacagtgtacactgctcaggtgacgggtataccaaaatctcagaaatcaccactgaaggacttatccatataaccaaaaaccacctgttcccccaaaactattgaaattaaatttaaataaataataaataaataaagtacatgacagcagcaatttagaaagtgcataatttattacatttataagctcataacaaaatgaatacttaggaacttttaaaatgaatttgaagtaacaattagatgtaaaattctcaaagcttggaacctgaaatattaaattctagaatttcttaaaaacttcttcttatgtaagagaaacttgcatagtttgaaaattattatgttcttccaaggaaaaaaaggaggaattaaaaaaaagaaacaaagaaagaaaaagtttgctgagctatgcaagaaaatataagaccctagagcacagaggccatgttgtaggctggtcttactctcccagcagcacctggcaccaagtaaaaagcagttaatgtatgcttattggtagattttactgacctaaaagtaggatatctctaaatgtagctgaaaagtcttctgatatacatacgtttcacacttgcccttattcaggctaatttccacttctagaggaagctctttaccctccattttacccttctttttgtaagttaatatttagtacctaaattaatcccacactagctgtatgactaatacagagagtactccatgtataccctgattaagttcactggacagatgctttgagggccatcagttgcctttcacaccaagaacaatatataacaaagaagcttttaccacctagcagtaatttcaaggcatcagtcatttcccagacatctgttgggcatgttctctgggctactctagataaagggctaccaagaagaattagacacagcctccaccttcaaggagctgagagtgttcttagacttaatctctttagactcatttcaaagtgaacacagagtaaatcgcatgacagcaaagaggacctcaagctgctgacaagggaaaaagatccgctgaattattccatcaggacttgggtgtttcctgtgttcagaggtcctggggcaatagaaggatgtacagtcacggctccttacctgaagccatatacaggacagggacaaggacaatgttgtgtcataaaaaagagcaaatggaagaagaacacagtcctttggatccctgaagaaaaagagattaattgtgacaggatcagagttgaagaggaggtaagagaagacctgtgaaggaggtttttaaatatattttaaacaagaagatgaatttcaacagaaaatcatttgggatgagggaagaataaaggcacaaagatagacaggtgcagtgcctggctgtattgtccatgctctataaggggagctattgtcatacagtcaccaaatgtttattgagtgcctattctgtgctaagtgatgtatctgagagcgaggcaagttccctttagaggcagaaaaaaactacttcccaggtgagtttatattgtcatccttctgatgtaaagaaagcacagtgtgggtgaggaacatggtggaagacaaggctcaacaggtaggcagggatccaactgtgaaacgcctgggatgcctcgccaaagaggttggattctactgtaaagatacttataatattttacatattatatattaaatatagatacagtcatgcaccacataatgatgttttggtcaacaaggaacaccacactatatacaatggtgttcccataaaattataatggagctaaaacttcctgtcaccgtgacatcatcgccttcgtgaaacagcagcacgaggcattactcatgtttgtggtgctgctggtgcaaacaaacctactgcactgccagttgtataagagtataacacatgcaattatatacatattatttagcaatgataataaatgactatgttactggtttatctatttactatattatactttttatcttgattttggagtgtgctccttcaatgtaaattttttaaaatttaactgtaaaacagcctcaggcaggtccctcaggaagtatccagaagaaggcattgacatcataggagatgacagctccatgcgtgttactgcccctgaagaccttccagtgggatcatcaacatcaacagtgatgttgatgatcctgatcatgtgcaggcctggactaatgtgtgtgtttgtgttttagtttttaacaaaaaagttaaaacagtaaaaaaaattaacagaaaaaagttcataaagtaagaatataaggaaaatatttgtatagctttataaaatgtaaaaatttacagtaagctaaaaaagtttaataaatttagtataacctaagtgtacagtgtttgtaaagtctacagtaatatacagtagtgtcctaggccttcacattcactcaccactcactcactgactcacccagagcaacttccagtcctgtaaactccattcatggtaggtggcctacatggttctcctaccttctctctttcataccacatttttgctgtaccttttctacgtttagatatgtttacagataccattgtgttacagttgcctgcagtattcagtacagtcgcttgctgtacaggtttgtagcctagaagcatatcacataggtttgtagcatattgcatagctgtatagtagactataccacataggtttgtgtaagtatactctatggacattcacatgacaaaatcacctaatgtcacatttctcagaacattgccccatcattgatatagtactgtattataaattaaatatatatatatttaatataatataaattctgctcacattttagggcactaaggatcattgtaacactggtcttcaaaaccaagcgcatttacagcaaagaacagaacataatatgaattcaactcactatgagacgtattaccactcatcctcaaatgtttgaacttgatcattttgggaaatacagaaggggcccagtatatgtcagtacagcaggcaatgtgctccttgtattgctagctatggattagagatcatttccaaatgacccaaacttaatattctatacaatttgccagacgtatgtatgtgtgtgtgtgtggtatgttgtgtgtgtgtgtgtgtgtgtgtgttaatagatatacactcttagtcatatgattattatttttttttttgagacagagtcttgctctgtcacccaggctggagtgcactgcaatctccgcctcctgggttcaagcaattctcctgcctcagcctccccagtagctgggattacaggtgcatgccaccatgccaggctaatttttgtatttttagtggagatggggtttcgccatgttggtcaggctggtctagaactcctgaccagtgatccacccaactcggcctcctaaagtgctgggattacaggtgtgagccaccactcccggcccttagttgtattttaaaagcaacaaaatttccttccctacctgaatgctcctttatgagatagctccagacatggcagtagatacataccttttagcagcttaatccccaaataaaggggatttttcatggctttttcaagattagtccaccagcttttatgtcctaaagtggcctatttcctaaaagcgacttcttttatccttccttagtgatatttcttccctaatcatcagtttttcctcagattctttaaaaaaaaaaaaaaaaaaaaaactcatcttcatgaattgtcatcccataatatgccagggtgatttaatatttcagcttttcttggctaatttatcttgacttgactgtgtttattaggctctaaataaggatttcccaacctcgacatcattgacattagagaccagataaccgtgttgtcgaggggcctgccctgtgcattgtaggatgtttagcagcatccctggcctccacccacaagctgccagcagtgccccttcccacacacacatccaccttgtgacaatcaaaactgtctccagtcattgccacatctcctgtggggggcacaatcttcccctgttgacaaccactgttctaaactttttagtttcattttattataataataataaaagataacacatattgaggtttacagttagccatccactattccaatcatgtttccagattaactcaatcctcacaatgacccccattttaaagatgaagaaatactcagacaagataagtgtcttgtctaaggccacgctgctgctaagtggcagaatgatgtcttgaacccgattccactgatgtcagacccttagctcttaactactagaccatttggcttttctgaaattgttcaaagtcaacaccagtagaacaggtacaggctttctctttgtcttccctacttagtgtcctgaagccatccagaaaacccagcacacatttgaggatttatcatttgtatagcaggaattctcgcatcttcgcagaagtcaaattcaactatctaacaactggtgtggctcggcatggatggatcccatggatgtggatcataaacaatccatatgagtatgaccagccatctggtgcctacaggatgaatggaactctgcattttcctcaactaaagttttattttgcccaagcagtcactgccttgggtatgcattcatagagtacctgcagggtgcagagaactaaaaactggtgtggacactttaaaaagtaagagatgagattctgctttccaaaatttcaaatcccattagtaggacaaaacacccagctacaacatgacattaagaagacttacagtgcatcacacagcaaacattaatttcaactaagcggggggtggggatcccaactcttatgcaattaaaagttagaattatagaatatttttcttagaaacaactttttaaaagcaagtgatcaatcaggctaataatatgttatgaatatgcacacctaagaagcatatttaataaatctaaaaatgacctgaagttctcctatcaatttgtttataatgaatagttttctattatgcttgaaagtaatttgtgctctttaatgataaaaacatttcccttctgcttcagtgtaatctattaatttgcttagtaaatgctttgcaaaggcaaacttttgcccagtccatacaaactggtgcaaattttaaatggttgggttatgtaataattatgctttcattagagaaatagtctttcttacaactattgaagactgaccaagaataaagtggtgggtgggaagtaacttctcagatggttctaatgagcccctgagctgaaaacaactgggtaaaggaatgtcggtgcataagggaaatgaggaatggctaggcgcaccgtggtacagactgcaagctcctggacccctgagttaatcagctcttctaccagctcctgctctatgaccttcagcaagttatttcctcccactgatctttagattcttcctttgcaaaatggatttgttcagtggaacaaatgagaaaactcatgtaaagagtttaacatgctatctgaaacacaggacatgcccaataccttttaataataattgcaggcattccacatgaggtgacttttgagttaagtcttggtcttgatggtgaaagtaaacctatcttcctctaataattcttgtaattttttcattcctaccaattcttttccttagtttgttggtttattttttgttttagagacagagtcttgctccgttgcctaggctagagttcagtgacacaatcatagttcattgtaacctggaattcctgggctcaagagatcctcccacctcctcagcctcccgaatacctaggactaaaagcatgcaccaccatgcccaggtaatttaaaaaattttttttacagacagagtctcgctatattgcccagactggtcttgaactcctggcctcaagcaattctcctgcctcggcctcccaaactgctaggattacaggtgtgagtcactgtgcctggccctactaccaattattttcttttaaaaatgggatttagccacaaaatgtattgatatgctgcacggtcttcctatttataatcaacattcaagatcgaattttccatttgctcctcagttatcccaaatcaaactgatttgttactctttatctcctgaatccttgagctccctactctgctttcaatagcgtcccatccttgccaacaattatgcaaacatttgcaccacctcaaatggctaaggcaaagacatatttgcttctacatgcttctttccaataactaattctgtaaacacaataaagtacattccaggcagtgctgaattttttacagtattagttataaacccctaaaataatttataatggaaattctgagatattcttcactacagaggatattggtcctagacccagcaacaaaacacgtgttcacaggcacacacaactgtatgtatgcaatacacgtacacagaaaagagttctgttcacttaacccaaatttattcagaacagtttatgttatttattttcatgagttttagacaagatcttttttagcacattacagaggcctggaggggctttctgcataaaagacaaagccaagcactgttaatgcaaagtatagtaactcagtgttttgagaaacatggccaaatgtatttgaacatgaggccatcaggccaagaaatcttggtgtctagagctgagagcaaaattggcagttgggttcttattatcaggagaatttcttgctacattgtggccactcagcttagcccacctcaaccttacaaggatgcatatgcatgttttgaaaacatttaagatgcaaatatttcatatcatacatatgctggtaaaacatgaggcatgagagacctgtttgcagtccttgctgggccacttacaaagaatgtgacattaattcaccttttttttttgagacagagtctcgctctgtcatccaggctggagtgcagtggtgcaatctcagctcactgcaagctccgcctcccgggttcacgccattctcctgcctcagcctcccgagtagctgtgactacaggcgcccgccaccacgcccagctaatttttttgtatttttagtagagacggggtttcactgtgttagccaggatggtctcgatctcctgaccttgtgatctgccagcctcggcctcccaaagtgctgggattacaggcgtgaaccaccgtgcccggcctaattcacctgtttaacctttctaaccctcagtttcttcatctgaaaatgtcatagcaatagcatctacacactacaggttgctgtgagaattaaatgagctaatacatgtaaaatgctaggcacaatgcctgcaacagtaagtgctcaatatgtattaactaagattagtatccattttatctgacatttccattataaaccacactcacaaaatctgcatcaaatttcttttttttttttttttttttgagacggagtcttactctgtcacccaggctggagtgcagtggcacaatatcggctcaccacaacctccacctcccgggttcaagcgattctcctgcctcagcctcctgagtagctgggattacaggcgcccgccaccacacccggctaatttttgtatatttagtagagacggggtttcgccatttgggccaggctggtcttgaactcctgaccttgtgatccacctgcctccgcctcccaaagtgctgggattacaggcgtgagccaccacgcccggccatcaaatttcttaaatggatattcttacacagtaagagtgcacccacaaatggttttgcaccataccacccaaaaatctaaagtccaaagataaactaaaaactagggcccatgccatgctgtatattatggaggaaaaagcaaagaaaaatctcccacaacatgaggcaagagacaggagtagatcagatcatcacactaagaaaactgctattcaaacagcttacctttaggaagtatgagaattttaatgtccttggagtgctatttggggttcaggaagaatcttttcctggaataagatctaagagggcttacaaatatttcaccttcaaaatgtagcattgaaagagcaagatgacacgctcgcttcagcagtacgtacaccaaaactggaacagaagagcaagctgaggcgcttgttccagagtttggcttctcacccactccacatacgcacacatattcaggtaattcaggaagcacttcaggaagccccctcattatatattttaaaagctccctttccatcaataaaaaggcatacatttctaataggtaaacatccgtcagttgaacaaacctgaagcatgactatacctaagtaaagttgccttcattttctaaaactcctgggcacacttaaatggatgtgtgaaattccatgaactccaagtatgggacggggatcactaaggtgctttaaccttataacagtgagacccagtgaaagatggactaactgatgaacccgcaaaccagcaaaatcttaatgcctaatagcaaactatgttgaataaagagccaatcaaaaatttactagaacatgaaggagactttaagagaccacttaacacaggctgcctggagagtgagaccttctgaaggtgcactgccatctaaacacgataatattgcagggatcccaaacaaagttatacacatgtaagggctgaagacatttctcacccaccatagaaactaaagaagtttcccaactgccaccagaaactacagaaagttcccaacagcctcacaatccaacctttcaagttgatcaacagaacaacccaaatgtccagttaaattctgtctggctaaactctgtaaaatgcaaaaaagtaagacattatcagtattgttcagtgagtttaaaagaaaaaaagctcaaaaaatcatatactatttcaatcttggctggtatttatccctacagttgatacaactgttttattttaaatggattgtaaaatgttaccagaatggccttaaaatcaatttaataactgatctgcactctcctggtacacaggaaaagcaatgtccaaaaatgtccaaagagaaacctggcaagaagaaaaaaataaatctcattcaaggctgccatctagtgggcaaatgaggtggctgtaatgttgctaagcaacatttggatggcatatttaaaactgtagaaatttggagctaagaagaaacttagttcagtgtttcccaaagtatatttcttgatagcaggattctgccatcaaatgcatttaacacatgctaggtgaaatgctgtggaaaatacatcttaaccataggatatctcacagccttaaatatgttaacctatattggaaatctctaaacggagacgtggcattccgcacttgtattcagtcagggaaactctttacttgtagatgcctctgaactcctcatagagtgctggagtttctcaaaacaatgtttgggaaatgctaatctaattcaactcttgcctccatattttacacaggagggccccagtaattgaagtaactggtcctcaattgaagtaattgaagtcctggttctcagcgctgccttatagctggtcaagttccatggcaggtgtgtctttgtaacccgagggctgggtgaaagcaggagggaggctgtaaggtgctcccccttgctcctcatccttagcattaaaattctcctgtgggaggtctggaggcttcatgctaagtgcctattaggcttggacatcctataacagttaaaatattgattttaaaacctaaaataatactttccttccaagttcttatggttattttttaatctggctgaaaattgatcttaatgttatagttcatctctatacgttttattgttatagttttgtaaaaacacaaattaagagtgtgtgagagttatttctgatgcctcccatacatgttccatctaaggttaaacctgaaggacaaccacaatatctagcaatgactgtggacatcaaaaaccaaagtattacgcataaaataatagctttaacaggggcatgcctggccgggcacagtggctcatgcctgtaatcccagcactttgggaggccgaggtgggcagattgcctgaggtcaggagtttgagaccagcctggccaacatggagaaaccccgtctctactaaaaatgcaaaacaattatctgggtgtggtggtgcatgcctgtagtctcagctacttaggaggctgaggcaggagaattgcttgaatccaggaggcagaggttgtggtgagccaaggtcgcgccattgaactccagcctgggcaacaagagcaaaactctgtctcaaaaaaaaaaaaaaaaaaagacatgccttacatttgcccaactgaagaaaatattacatgggatgctaacattggaattacaaaagcagcttccagagatgttattacaaactatcctgaaaacttaaatagatcttcacttggaaatagatagaaaactttttaaaaatacaactgtgggcattgtgcttatgggcaccccagggaacctatggagacgtcagctatgtagcaactttcagagtactttgttcaggtggtcctggctaagtggtctcaggttccacatcttctagggacagcatgagccacagccagatctccaactctcacacctgttccagtgtttttcactgctgtaccttaccagctggttattctaagaaggaatcatgtgttcacaaactctggctccagagaccattcccttctctcaagactgaaaaatgtaataataataacttaatgaagattaaaaataaatacaagtaatcccagcttggtacttttaaaataattttgatggctatatgatattctatcactgccagattcctatttagaaaattttaagttttctcttatttaaaaaagttttaccttatttaaaaaactgtttaagaaaacttacttttctttttctaaaaaagggaggaattgctctcaacttctttaggcacaaaatgttttctctactaaaaatcatctctaaaggatatcttccagaagtggagttacggaatcaaaaggttagactcatttatgttgacaagcttttttcccaaaatagttgtcccagtttacaccaaatttggaacattttagcctcagttatgaatgggaggcttgagagataactgtaggtgtacagaccacttgtggttcagtccaggtcaaacatgcacagcaactggaaggctctggaaatgctcatttgtttgcacatctctcagactttaagaagcctctccctatatatgagatacaaatgctaaagactccccaggtctgttgtggtggctctataatcccagcactttgagaggccaaggctgaggataacttgagcccaggggtgcgaatctgcaacgagttataatcgcaccactgcaatccagcctgggctacagaggaagatcttgtctcaaaaaaataaaataaaaatttcccaaactcaaagaaaagctcttacttaggaattcaacctcaaggtcttaataagagtttaatacctgcatataggattggtgtttcaatgggattaacagggaccaaaatgcaaagtggaaaccagactaaagtattgtcagttagtttagatggattgggagagggctagcgcccaagtttcaaacctggcacagctttgcaccagagagctggcttgtaattgctttatgtcgtccccttttattttccccatggattgctgcggcatgatgggatgttgcaaagtgactctaacaggcagagactaatttgaaatacttccttggctcctcacatattctaaagcaccccccaacaactatactcagcccaagagttaacagcattccttaagagcccttaaaccccttttttttttcactttgaaaatgtaagttgatggaatcctgctcgtttacattctgtgtattttctgacaggacccgcaagtattttcaaaggctccactctgagttagaattagcacattagggacagcagattcactgttaaggaggaggccccacctctggctcatttttctttccttaccttgctcagaacaggattccccacataccaactggccagctgacactgttgcacatttgcacaatcattcattcattcattcaaatatttactgtgctcttattatgtatgtgtcaagtcccgggccgggatctgaaagcccaaaatgaatgttgaatcagtaactccagcctcattcatctatcagttgtgtcaccttggacaagtaagctaattttcctgagcctcagtttcctcaactgtaaaatgtgggataacaatagtctctgcctcacaatattaaataattgtacatacttcccaaattaagtgtaataatatacataaagaacattatatctaacacctgttaaatagtcaaagaatatagtttagtcactaatgtgaaaaaagaagataataatttagctaattccggtgaaaaattattgtagcaattattcaaagaccatgtgccaaatataatgttttatttggtatacaaatattatatctccataatgaaatttcaacgtagttcacaattcttatttccatcccctagtggagaataaagggacaacggccttaatcttgacttagaagtaacacagttatcatttgttcacacctgtccctgaagactctctcctttctccatcttttcatctacctctaacttcttgacactgggaaagtggcctctggggcacacttgtcctctatggatgtgtgagaatagctggtgccatctacatttaggtgttggcctctggcatcaactacttaaggctgtaacccccaccacggactccaacaaggtccacacactcttgagtccttctcatccccatcctgggcttccctagttttccaactgtctcagctccctttgatagctcaagaccccgcagctgctttcgccacaccacactggggcttgagtcctataaggctgtcctcagccactaccatcttgaccatgcaagaggcctattgaatgtgcatcatctcatctccctgggctgccctgggaggcaagctcatttaccctgcttctctgggctcctcctgaggaatatacagcctagatactttcgagaaatttctggatctgaggagcccacatctatttccttcttccctcacctggaatgaggcagagtgcagggaatctctactcaggcacccatctgctttgcaagtccaatcacgtccccttggatccatctctttctgccagtgggttgaattctttctttcctttgggttggataagtgctctcctgccatttaggcattctctactctatggcttagaccctcactgttcaaaatggtctgcggaccagcagcatgaatgtcgttgcctaggagctaattagaaatgcagaatctcaggctccacctcagacctaattaactgaaagctgcatttgacaagattcccaggtacatggtaagctcattacagcttgagacacagcaggttaaagataaactccaaaacagttccctcaatgtggatcttcctctacaaggacaagaaaaatcatctctctttccacaaggctagctatggcaaatcaaacgtaacttggtgttcagactactgtaattttttaaactctgtctgaaagctttaaagtgagccattaccccttccacagaacgaaagaatgcctatgaattgccaggaggagacctgcagagacaactaggaacaaccagtacttaccatgaatgaaaatcacattggttaatatttcaaaaacattaacttgctaagtgctcatttccaacaggtgattaaaatcaccttgaaataaagtgagtactgaataacagagagttggacacaaaattaaactaacatgagctgactgtggctctgaagttaatagctcctaatgagaattatctcaatatccaggtatttgagacagatttattttctctccttaacatgtcgagagagtttgctcttgatttccaggaaaacttcataatttatcttttcttttgttgtaaccagtgacttaatttccaggaatttttttttttttatgggaggcagcctgatgtaacagaaagactggaccatgatacggtttagctttgtgtccccacacaaatctcatcttgaattctaattcccacatgtcgagggagggacctgtaatccccatgtgttgagggaaggaagtgattgaatcatgtgggcaatttcccccatgtggttttcatgatagtgaatgagttctcatgagatctgatggttttataagtgtttggaggttcctccttcacttttctctctctcctgccgccttgtgaataaggtgcctgcttccccttctaccatgattataggtttcctgaggcctccccagccatgcagaactgtgagtcaattaaacctctttcctttataaattacccagtctcaggcatctctttatatccatgtaaaaatggactaatacaggccatatgtttaaatacttacttttgtgaccttgaaaagaattaaccagcttccatatcttttaaatgggggtaataattctacctcagagggtcaccatgaggattaaatgagataatgtatgtaaaaccactggaatgaaacaagtgctacccacccccaatctcttctaggttttcgattccaggtgatcttccggacacctccagatgactttcatctatatatatctaaaattgtgcttggttcaacaataaatcccatcctctctgatttaaaatactgaaaattcatttccaaacatatgttccaagtttctgccctagtaaagtggcaaaatatttcaattcttttggtttataatacacattaatgcatcatggttacagtcttcatcagggatggcaagcttgagaaccacctgcagttcaggcaatttaacttacgtcaaaccaaacagcctcatccttatctgcccaatgctaaggctccatttcccaccctgaataactctagcagctcatatttcactgaagttacaaaaacagcaatacttgaggaatttaccaagcaaaaggccattttccatggcatcacgttcaaggccaaattaatgtgttgatgctttcacaattaggacaaatatagaggatttggcacattttgcttttcggccattgccttgcatgtatgacattcactccattagtcaactccagtcatattttctttttttaaatctgattctagcacagaatgaagtttatcatctttgtctacaaaaaaggggaaatggactgccagagatgtaaaagcaattcccagcatgttagtaattacagaggtttatcctggcttaaaaattctcatcaaggattttttattttttaggttggagacatcatgtcacagtaccagccacttcagttcacaatggagataattagacatattcagggtgaccttctctctcttctgaatgcgtccctgtgctttcagaccggcagcttatacacaattttttaagtaggataatcctttcattcttcatatcaagtcatgcacagaagcctgagagcaaaaagggcagccaaactcctctggatgcagcaggactagggggccagatgccctgccctgctgggtctcacctcacagcagatcctagactctaggaccctgcagtgcacctttaaaactcactgaccaagatgatctagactagggattggtaaattctttctgtaaagggccagataataaatattttcagctttgaaggccatacagtctctgtcacagctactcagctctcttgctatagcctgaatgcagccagagacaatgtgtgaacaaatgggtgtgctagtcctccaataaaatatgtactggccgggcgcggtggctcacgcctgtaatcccagcactttgggaggtggaggcgggcggatcacgaggtcaggagattgagaccatcctgtgaatggtgaaaccccgtctctactaaaaatacaaaaaattagccgggcgtggtggtgggcccctgtagtcccagctactcgggaggctgaggtaggagaatggcgtgaacccgggaggcggagcttgtagtgagccaagatcgcgccactgcactccagcctgggcaacacagcgagactccgtctcaagaaaacaaaacaaacaaacaaacaaaaaactttatgtactaaaccagggagctggctggatttggcccatgggctgtagtttgccaaccctgatataaactggaaatgtacctttgttcacgtgatattcgagatggagaagcagcatgtatcatagagagtgccccaaactccactttgtacaacttaaactttgatttattttcattttacccctaaaatttaccaaagtagttaatataggaaaattgtatctctttcattcaccaggtagctgctttgaaccttaaaactatgtttttcttttaattaattaattaattttttttttttttgagactgagttttgctcttgttgcccaggctggagtgcaatggcatgatctcggctcacagcaaactccacctaccaggttcaagtgattctcctgcctcagcctcctgagtaacgggattacaggcctgtgccaccgtgcctggctaattttgtatttttagcagagacggggtttctccatgttgatcaggctggtcttgaactcccaacctcaggtgatccacccaccgcagcctcccaaagctctgggattacaggagtgagccactgcccccagcccaaaaaactatgtttttctttataaatcatgatcatctcaaatgtaatctttcacacacagtgcattttaattcttggaagatgtacgttcactgcaattctataggtcaacccgccttaccgcaaaaaatatatttcataaataccatataaaattaggttgtgtccctcctctcctgtgtaagtagccaattttatgaaaaattgagcagaatcaaaaaagtttccttataaaaaacattatatcagagtgactggggacacaacaggtatgggggaggaaacgtgggttttagaataagttttgatataatatcccagataccctctaggttattatattatatatttatagtatgtaattctggtacagatttgatatgatatgatatgatatgatatgatatgatatgatatgatatatgattctgaaaacaatcaaacagagcccctgccctaagggaccatggaaagggctgcccagaagccttgctttttccatgtggccattctcagcaagctaggcctgactggtacaaggatgaaaactgacccaagctgggctgcctcccagcttttggctggatctataaaaggtaaattcaagagctatgggttggctgatgttaccacatagacccaaatgcagaaaaggcaggagagatggaacccccgataggctcgggttcccaccaccagcgcttcctcagggccagcagcacccagcacttggattccataagcttccttttcagtgaaaactcattttctaatgttgctaactagagtttcttgcaaccacagagtctgaacttttcatacactgccctgccccacttctcattccacctttccagccacactgctcagtcttctccagagagaatgagaatttgctccctcagtccacttggtctgcaagcggggaaagcaagctctatgagaatgttgtgggggaccctcaggaaaccactcctccccgtaagtcctgggactctctgccactgccaaacatcttcttatgggaagcagatgagaataacagactttctataaaagttaagtgaaaagcttaccaaataaggcaaaaaaaaaggttgaatgagatgtcgccaagggcccttaatttctgtaccaagtgaaacaattaaaaaacaggagaacatcgcccccgcgccccagccctggaacagcaattcacagtggctcccaggggcttggctgcaagctcaagcagcccttctgttacccacccagagctgtgggaggtgggccagctctggggacaagcactgctcacttagttgaagcatccttccttcagtcaaaccgaagatggcagatccaggtttggctctggccataatagctccagagcctgtgttattaaccgctatgctccaccacttccctctggcttctcctcctccctccataccctgacctgtccaacccatgttccactccagatcagccttccttaggagcagctttattatcatcactttcttgctgaaacccagcagctgcatcttgttcccaggccaattctcagaatgccaatttgattatgtcccagcatgacccacaaccctttagtggcatggtctaccatatctcacaaaatctttctctaatgctcctctgtgtcctaatgaaaacctctctccttgtccactctattggtattctcgacaaattaattcagttccttggttgcactagccactgttcaagtgttcaagagtcacacgcgactgtaactaccacattggacagcacagctctaaactttccttggttcttctaaggtcccagctctctgctgcctccagcctttttaagctataccctctgtctttagcgggttcccagtctctctttcccaaccctcttcttaaattccttttgatccttcaagtctcagcttaaacacaactaatccaggcttcacaagaagctttccttgccctctcatgcctaggttaagtaaccctcttaaacactccagaacatatttaataattgagattatttatatacaatctgttatttcccataaggatacgtacactatcttataaacggctctatctacactgtctagtggacagtcaataaagactcactaaccttattcttgtatataacgtctacaagaaggggaagcctcccctacctttcaccctgaacttcctctgatcctccctgcctctcctacaccccagccattaaataaattgcacagcttgtaactcactctcctctggactcatcctgtgttctcactcgagcttttcctgaactgtgccctctctggctatcccatcccatttcagctctcaaactctgcccctttcaaatgccacttcctacagggagcctttaggattctcaacattgagctgaaattgtttattctttactttttttttaacttttattttaagttcaggggtacttgtgcaggatgtgtaggtttgttacataggtaaacttgtgtcatgggggtttgttgtacagattatttcattactgaggtattacgtctagtatccattatttatttttcctgatcctctccctcctcccaccttccaccctccaatagtccccagtgtgtgttgttcccctctatgtgtccatgtgttctcatcatttagttccgacttacaagtgagaacatgtggtaatttggttttctgttcctgtgttagtttgctaaggataagggcctccagctccatccatgtccttgcaaaggacacgatctcattctttttcatggctgcatagtattccatggtgtatatgcaccacattttttttatccagcctatcattgacaggcatttaggttgattctatgtctttgttattgtgaatagtgctattctttgaactattttgtagactatgtttggaattgctactcttcaagtgtgtgtctcctcctgctggcccctgctgtgtggcttgaagagcaggggccacatcatcccagtacccagcacccaccactgtgtctggcacatggcacacactcaatgaaggtgaagttgtgggggaccactgaatatcagtcagagtcatcaacaagtgaggatctgctgagcttggatagttaacaaagatgatggcagaagaggaactgcaaagtaactatttgagtagcaatgtattaaagaggcagcagagaaagctaatgaacctctccagtatacttttggcaaactgattctcttttaaaagacagtagtgtaaaggccaaaggagtaacagatattccatcatggtagctgtcaattttactggaaaaattatgccctaatgaaaactgatatttgagtttcattctttgttccttctaaaaatgagcacagtttcacttgtcacctacattttgttaaatgtaagagttaaacactcatttcataccatttaatttcatttgcaagatgaaggtccaatctaaagttactaactttcctctcattacatatacaaattttggtccccaattttggtatcaattggttccaacatgaatatcctcacataaggaggatctccttcatagggatacagttgtaatgaattccctgtaacaatttaacattccaaagattgtcacttcttctttggtctcaagccaattcacctagagcaaaattatcctcttaatacccacatagaaactggccagagatgttttcagaacaggaagctctacagcagcaacaagcaaagcaaatataatactagcccatttccattcatcttactgcctttggcaaggaagagcccttaacatttcactctcaggcttatgtaacttacaagatagtaacttaagttcaaagtgttttttatttttagtctgataattcaattcacttttgattttctcactgatttacaaatataatataagaaagggtgagacactagcaagatggtggagtaggagaccccagccatcacttcccccatgaagagcaacaattcagcaactgtccatgaaaaaaaaaagtgtttctggaagagcttagcagtctacttaagtagcctcaacaatacagtgaaattaaaaaaaaaaaaaagccatgagaatcacctcccaaaaataataggaagaacagtttcattttctctgcaccaacccatctgtcatctgccctatagctgtgatcagcacagagaggaactccctagctccagcagccccccgcagagaaaaggatcagaaggggttgttataaacaactatatgccaacaaattggataacttagagaaatagataaattcctagaagcataacctaccaagactgaatcaagaagaaacagaaggtctgaccaaaccaataacaaatatagactgatgtagtaattaaaagcctcccaacaaagaaaagcccaagaccagatggcttcactgctgaattctaccaaacattaaaaaaagaattaacaacaattcttcttaaattctttcaaaaatagaactagaggcaatacttccaaactcattttataagaccatgattatcatggtaccaaagcccaaaaaaggcaccacaagaaaagtataggccaatatctctgataaacatagaagcaaaaatcctcaataaaacatgagcatcctgaatttgataatacatcaaattattatacattgtgaccacaatgtatatccctgggatgcaaggttgatttaacacatgcaagtaaattaatgtgatacatcacattaacagaatgagggctaaaaaccatatgatcatctcaatatatgcacaaaaagcatttaacaaagtttaacatcctttcatgttgaaaattctcaagaaattaggttaaacaaagtagtttcctcagcataataaaggtcacttatgagaagcacacagctaatatcatactcaatggggaaaaactaaaagctttttccttaagattccatatagggcaagaatgcccactcttgccacatctatcaacgtaatattggaagtactagcaagatcaataaggcaggctgggtgtggtggctcacgcctgtaatcccagaactttaggaggccgaggcaggcagatcacttgaagtcaggagttcaagaccagcctggccaacgtggtgaaaccccgcctctactgaaaatacaaaaattagctgggaatggtggcgtgcacctgtaatcccagctacttgggaggccaagacaagagaatctctagaacctaggaggcagaggttgcagtgagtcaagattacaccactgcactccagcctaggtgacagtgtgagactccatctcaaaaaaaaaaaaaatcaataaggcaagaacaagaaaaggcactcaaatagggaaggaagaagtaaaattatccctatttgtaagtaacatgatcctacatgtagaaagccctataaagaccccataaaaaaactgttaaaataatagatgaattcagtaaagttgcaagataaaaaaaatcaacatacaaaaaccagttgcatttgtctacagcaaatatgacctatccaaaaaaaaaaaaaatcaagaaaatgatccgatttacaatttcaaaagcaacaaaataggaataaatttaaccaaggaggtgaaaggtctgtacactgaaactataacacattgataaaagaaatcaaagaagacacaaataaatggtaagacatcccatgttcataaattggaataatcaatattgtcaaactatccatactatccaaagcagtctacaggttcaacataatctctattaacattccaaagtcatttttcacagaaatagaaaaatagttctatgattcatatggaaccatgaaagacctcaaataggcaaagcaatcctgaggaagaaaaataaagtggaggcatcacactccctgacttcaaattatcctacaaagctacagtaatcaaaacagtagggtactcacataaaaacagacacacaggccaataaaaaagaacagagagttcagaaagaaatccaagcatatatggtcaactaattttcaacaagggcaccaagaagacacaatgaggaaaggacagtgtcttcaataaatgctattggggaaactggatatccatatgcagaagaatgaaactgcacccttaacttacaccatacacaaaaatcaactcaaaatgaatgaaagacctaaaagtaagacctgaaactgtataacacctagaagaaaatataggaaaaaacttcttgacattggttgtagcaatgatttctcagatgaaacaccaaaaacataagcaacaaaagcaaaataaagaagtgtaactacatcaaactaaaaagcttctgcatagcaaaggaaacaacaacattaaaaggcagcctatggattgggagaaaacatttgtgaaccatatatctgataagaggtaaatattcaaaatatatgagaaacaaaactcaataggccaggcacagtggctcatgcctgtaatcccgacactttgggaggccaaggtgggtagatcacctgaaatcaggagttcgagaccagcctggccaacatactgaaatcttgtctctcctaaaaatacaaaaattagccaggtacagtggtgtgtgcctgtagtcccagctactcaggcggctgaggcaggagaatcacttgaacctgggcggtggaggttgcagtgagttgagatcatgccactgcacttcagcctgggtgacagagtgagaatccgaccaaaaaaataaaataaaataaaataaaataaaataaaataaaataaaataaaataaaataaaattcaacagaaaaaatacaaaaacaaaaacacaaataactagatttttttttttttttttgagacggagtcttgctctgtctcccaggctggagtgcagtggcacaatctcggctcactgcaagctccgcctcccaagttcatgccattctcctgcctcagcctaccgagtagctgggactacaggcgcccaccaccatgcccagctaattttttgtatttttagtagagacagggtttcaccgtgttagccaggatggtctcgatctcctgaccttttgatccacccgcctcggcctcccaaagtgctgggattacaggtgtgagccaccgcacccagcaaataaccagatttttaaatgagcaaaggacctaaataggcatttctccaaataagtcaaaaaatagtcttcaggtttatggaaaggtgctcaacatcactaatcatgatggaaataacaaatcaaaaccacaatgagatatctccccactcctgttggaatggcattagcaaaaaacaagaggtagccaggtgaggtggcacatgcctttagtcccagctactcgggaggctgaggtataaggaccacttgagcccagtaatttgaggccaacctaggcaacacagcaagaccttgtctgtgtaaataaataaataagcaaacaaacaagaggtaacaaatgttggcaaggatatggagagaagagaacccttaaatactgttggtcagaatgcagacttttaaataaaactaccatatgacacagcaatccttcttctagatatatactccaaggaaatgaagtcaccacctcataaagatatctgcactcccacattcactgcagcattattcacaatagccaagatatgggaacaaccaaagtgtctgttgacagataaatggataaaggaacacatacaggttgagaatcccttatccaaaatgcttgggaccagaagcattttggatttctgatttttttttcaggttttggaatatttgcattattcttaacagttgaacatcccaaatacaaaaatccaaaatccaaaatgctccaattagtttttcctttgaacatcatgtcagcactttaaaagtttcagatattggagcatttcgaatttcagatttttgaatttaggatactcaacctgtatacacacacacacagtggaatattattttgcttttaataaggagatcctgctatttgggtcaacgtgggtgaagctataagacattatgctaactgaaataaaccaaacacagaaagaaaaaggctacatgatctcacttacatgtggaatgttttttaaaaatcaaatacaatagaaacaggatagaagaatggttatggcaggaagcggggacagtgggtaaaacagggagatgttggcagggcgcagtggctcacgcctgtaatcccagcactttgggaggccaaggcgggtggatcatgaggttaggagtttgagaccaggctggccaacatggtgaaaccccgtctgtactaaaaatacaaaaaaaaaaaaaattaactgggtgtggtggcaggcacctataatcccagctattcgggaggctgaggcaggagaatcacttgaacccaggaggcgtaggttgcagtgagccgagatcttgccactgcactccagcctgggcaaaagagcggaactccatctcaaaaacaaaacaaaacaaaaaaacaggcagatgtaggtcaagtacaaagttgtaattacataggatgaataaatctagagatctaatgttcagcatgaggactatagttaataacaatacatattattaactatagttttatagatatattccagtattgcataatggaaatttgctaacagagtagattttaggtactcttaccacacagacacaatcaagaaaggtaactacatgacatgttggatatgttcatttgcttgaatattgtaatcacttcacaatgtacagtcaattcctgcatcatgatgtctcgataaatgacggaccacatatatgacactagtaccatatgattataatactgtatttttactggacgttttctatgtttagaaatatttagatacaccattgcattacaattgcctacaatattcagtccagtaatatgctgtacaagttagtagcctaggagcaattggctataccatatagcctaggtatgtaggaagctatactatccaggtctatgtaagtatactctacaatgttcacgcaatgtcaaattgcctaaaacgcatttcttagaacgtatccccatcgttaagcaacacatgattgtgtatcaaaacatcatgttgtataccttatatttatacaataaaaataaataaaaagcacatatataaaaaacaaaataaatataagagaattctaaaattctaaaatacatatttgttctagcccctacacaccttcagcaagtaaaaacttgagaaattctcagtattccagaataatacagaatttatatttgctaacttacaaaataaatcaacttttaatgtgttataattgtttaatttgttatattatagtaagcctaactggtataagtgacttgactcccacttaatctaaagcaagtctaataacttttaaatttcaattaaacattgaaagaccaaaatagaagggcaggccaatttggtaaagtttactcccccaatctaacaaaacgtatcgctttacaagttctaattttcaccagccttctcccagacctttccacactatatactcagctgactttaacctgatgtggaatgtccctaaagttgattgtgcatgactgtatatgtatatcaaaacattatgtggtacgccttaaatttgtgagtgagaccattcctattttctagtaacaatcagctaggtttgaggttaaagatacaaataggaggcaaaattataatagaaaaaaaatttcagatccatcaataaaaagaaaacaatggaaatttcattaagtactagcactttggctaacgttataaacatgcaagatcctaacagcttggaaaaaattgtaacacatccagctgtaaaggatattgagaagaactgagagttccaagcaccattttgactaaaaagcagtaaagtcaagttactattctgaggaattagatccttcctggttctcatctcaaatttatttcatcacaagctttatttcaccagtgctgaaacccacaaggagctacctaaactcactggcaccacaactatctagaagtcctatcttagatgatccaaattcaacacactaagacacactcaatttcctcatgggtgagtctgctcagaccctcctctgcataattttaacaagcttggcaatctaactcccagcctaaagaaaattaacaaacaaaagctgaaatgtgagaaaagtgctacagacacaaatattgtcaaaagtgagaggtgatgtcttagcaacataggaggaactaggggaaaaaaacacaaaacaccaaaagtggacattaaaagttcatctgagaccacttaggaaggaagcaaataaccctatattcccaaatacatctaaaggcacccaccccttcacaggaaagagtaataatagacatggttaatcatgaccctcagctatgaagaaaaggctccaatctgctcagaacggtctatgtgttaagaaagccaggaaaattcaaatagttgtaatttataaagatttcactcagagtggttaatcagttttgaaagtgttgacacttaaagggtgaggctctggtcacttggggaatagtcttataaaaaaaagctcctttttcccaccccatcagttaatgaagcactgcatatggacgctccacattggaagccgttccaaggacagcattccaaagtcagctataacaacaaacagcagatgtccagaaaggcacagatatctcctccctacacccaaaccatttaaggaggaaaaaatagaccataaaatgtgtgaccagataggcataattgtcaattagctgaaaaacaaatctctaagtttccaatgagggcacaagagcacctaaaaaaaaaaaagaaagaaaaacaacaaatcattctaatttttacaaaaaaatgaaccaaataaatttttccttgaacaactgccaggcctacaggcagatcttccaatacaaaatgatcaaacctgaagaattttcccaagagagtagatacttccaaacagcaaatttccattttaaaataagcacatttattgccatttttccagtttccagaatgtgtatggttgttaaatattaaattctagtttttaaattccggtaatggaggaaggatagcccatatttagggtggggccatgtgagggatgaatacccccaaattaataaaatctgtcaacttggcaaagaccagaactgagatctatctggatgaaatgtgactatcatggccaaatctgagctgtagtgtgtttcccaccagcatggcaggctatttgtgtattcatttataattttttcatttcttctacaaagactctgtggaagatctatggctgaaaacaaggcctataaaagaccagccatgggcagggcatggtggcttatgcctgtaatcccagcactttgggaggccaaggtgggcggatcacgaggtcaggagattgagaccatcctgtctaacacagtgaaaccccgtctctactaaaaatacaaaaagaaattagccaggtgtggtggcgggtgcccgtagtcacagctacttgggaggctgaggcagaagaatggcatgaacccagaaggcagagcttgcagcgagccgagatttcgccactgcactccagcctgggaaacagagcaagactccatctcaaaaaacaaaacaaaacaaacaaacaaaaaaaaccagccttgtactttcttcacacattttctttacgttgtgaaaaacttaagtgggaaaatcacactctcattcaaactgttcaaaatacaggtaacaatgccaaggaagatgaagcaacccagtggttcccactttatccattctttgtctctgtcagggcatgcaccctagtcctctagggtgatgaactcctcctggttttcccaggatttccccagccttaatgaaagtctcatatcctgggaaacccctcactctcaagcaactgggacggttggtcatcctacaggagcaatgacatccacgtgggcagcacctggagatatggttatgcacagtcccttgggaaatataactgaattcaagtaagtaggagtctcttgttcatatctgggttcaaatctcatcccttctgcttcccagcagtgtgaacttaaactctctaggcctcagtttctacagctataagatagagataacagaaccttacacaaggaattatatgagaattaagtacaatcacgggcccaaactaaactttctattatataagccatctagtagcattagctattatctccatcatcattattttttaacttttattttaggttcaggggtacatgtgcaaggttattatataaggaaattgcatgttgcaggggtttggtgtacagattatttcatcacccaggtaataagcttagtacccaataggtagttttttgatcctcaccctcctcccaccttccaccctcaagtaggtcccagtgtctattgttcccttctttgtgtccaagtgtactcagtgttataagtgagaacatgcagtatttggttttctgtccctgcattagtttgcttaggatgatggtctccagctccatccatgttgctgcaaagaacacaatgttcttttttatggctgtgtagtattctgtggtggatatgtaccaaattttctatatccagtctaccattgtccatcatcattattatatataatcataaagtttagttttagcacattatttgcagatttcatgaccttaattattattaagaacaaattgttacctccagatctaacaattaacgctcacacttgggaactctgctacattcaccactataaaaatgacatcaccaccaaaataaaaatccatgtgagacccttcttcgcaattcaaagtaaccaacctgggcacaccaaaaccaaataaaaacaaccccaaaagtatatcacttgaacaaaaaaagtagattttcctccatctcattcgctgtcaataattgctttctctctttcctgctctgcctatctagaagagtcccattatcagcatcaccaaggctgttgcctaaataggccaggttgaaaccaccattttcccatccttggtgactattcagatgcaattctatgtgaaactacagactccatctagaaagaaatggagatatggagataaggccaggcacagtggctcatgcctgttatcccagcactttgggaggccaaggcaggcagatcacctgacatcaggagttcaagaccagcctggccaacatagtgaaacgctgtctctcctaaaaatataaaaattagccaggcggggtagtgcatgcctgtaatcccagctattcaggaggctgaggcagaagaatcgcttgaacccaggagctggaggttgcagtgagcagagaccatgccattgcactccagccccagcgacagagattttgtctcaataataaaaaacaaagaaagaaatggaggtaaaaatgggtaactgcaggaacatgtctcaaccaaagacctaacactaggcaaacaaaaatgctcacatgaccaatgctacgttatgggaacagcccttgcatccaataagcaaagtcctgaagaacatacattagatgtagtctcacgtataaaaggggtaactcgtcctcatctctgtaacgcaataaccatgttaaccactttccttcatagcatcagctgatcttcaaccaatcacagctgatgagattcttccatatatcctgattattatctgctggacctgtgtcagcaaacctctgctatttaaatgatttcttccttcccttggaccactgggttgcttcatcttccttggtattgttacctgtatttgggaagtacggcagcatgaacagaggcattagcaaatgtgccaagatgaaaggggcattcaaggacacctcccactttttttttctttcttttttttttttttttggtgacagggtcttgttccattgcccaggccagagtacagtggtgatcatagctcacctggacctcctgggctcaagcaatccacccatcacatcttcccaagtaccaaggaccacaggcacacactaccatacccagctaatttttgtagagacagggttttcccatgttgcccaggctggtctcaaactcctggcctcaagcaatcctctcatctcaacctccccaactgtcagtattacagtagtcagccaccacacccggtcaaggacaccccttttacggaggattctttttttcacattcatgaaaatcaaacaaactgtattttttttcttatggctctcagccatattttttctttgggggtaatgatttgtattattttgcacaccagagtagaagctcccaaaaaaaggcaagatagcagggctgccactagcccatatgactcctttgtgcaaattagaaaatgaagccccttcccaagacacttcacttctatctgccagaacactgttgcaatgtactgattttgttagataagaaactgtgttgtcatcttctgacaagcgtataaaatatatgcaaatccatgatctccatgataaaaatggtgccctctagagttgtgcagtgcccaatctacacaattctgtacactgactctaaatgacatctcttcatgtttgtagcatcacaacatttcagataaatcacagttgtctcttggtatagatgaggaattggttacagcaggggtatccaaactccaggccgccaaccattactggtccatggcctgttaggaattagaccacatggcaggaggtgagcagagggcaagggagcattaccgcctgagctccccctgctatcagctcagcagcagcattagcttctcttaggagcctgaaccttattgtgaactgcgcatacaagggatctaggctgcatgctacttatgagaatctaggtaatgcctgatgatctggggtgaaacagcttcatcttgaaaccatcccctgcccagccctgtttgtggaaaaattgtcctccactaaacaagttcccgatgccaaacaggttgggaactgctgggttacaggaccacctaccacagcataccaaaatccacacacactcaagtcctgaagaacctgaatacacaaattcccctccataaacatgggttcaaatccagggaaacctgtattttcaatctgcatttggttgaaaaaaaaaatccacatatgagtggacctgtgtagttcaagcccatgttgttcaaaggccaactataattgtgatttgcctaaaaactgtcgtaacaagtcagattcaaatattgtttgtgtgggtgtgtgattgttctgtgtgtatgtacctttattatatattatttaaataaatgttgccaaaaaggagaattgtctatgtcaggttagattactggcccacagccatgagaacagctattcttgatataccaggaagagaaattttaaaatacatgccatactaaggcgatgacatggtgagagaaagaagaaaaaagaaaaatctggagttctggagcaatctgtttattcccaaggcaaaaatatttatccttaacttgtataaccaaaaatgtttctaatggtcacaaaaataattgccccatttcaaaatccagttgctatagtgcaggaataaagtttaccatgtgagcctcatcttccttaaacacttctacatttagctgccatcaacttcacctttcccacctttagattctggcctttaaatgagaccagtaagagttcacaaggcccaggataatgagttttccagaaacacgatcccagtttcccaagcaatggaagggccagactaccatgagagtcacagcttaaagaaagtaaataattcaaaaataaaaatttgtaaataagcagatttttttatgacctcctctgctggcagagcactaactcaagcagactgcttttcctcaccctctgatatcatcaccactagcaccagtgagtgtagtacggccaatgaaaacagcagagaggggaagaagccagcccagttgagattctaataagggttgggtatacccttcttgttgcttcagctcaatccactactatcattgtcataacacagaaagtttcttagtcccattttaacagaggtggaacctgagtctcagagcagttaaacaacttgccagaggtcacatagcttttaatggttaggcatgtctgggttcaaagctcttgcccttctgctacaccacactgccctgggtagagctttagatcagtgcatctcagaccttcatgtgtccacaggtctcttgaagatcttgttacaatgcagattctaattccagaggcctgggacacagctcttagctagcaaactcccagaagatgttgatgctggttgctggactgcacttttagtagcaagactttgaatcagtggtttttcaacaggggatgactctatcccacaggagacacctggcaatgtctgcagacatttttgattgacatgacttgggggagtaatgctactaacatctgatagatggacgtcagggatgttgctaaatgtcctacatgaggacaagcccccatccccagcaaagaactatccagcccagaatgtcaacagtgctggcgtggttgagaaacccttagagggcctgagttcatttagacttctttcaaagccgctgtagatttgcaaacttgcactggagttaaaggtagctctagtacttaagaaattctccataaagcctgatagaaatgttgatgccatgtaactgatagctggagcatgatgaagtttaatttcctcacaaatattctgtcattgtgctgaagaaaatcaaatcagctgattacagacaggggttccagaaactgcccagagtttctgtaaggtccttgtatcttatcactggatgtcacaatagaaaatgcaagggattagattatttttagatacaaattttataatttcctgttctggcagctcaaacctttaccttgttagcaaggatcacatgaaaccatcttttattattcagcattagctcctgaaacctactatcaatatcatgctgggatactgccatgctctgcacccagcatccattcaactcccaaactcagctaaaaaaaaaaaaaaaaaacaaactcagtcattcatctggctctttaatgtcacagcaccaaaaaattagttcaagttgaatatttttgactaaagtaaccatggcatattgtggtgttaagaatctttaaatgccatattgtttaattacagcatatgcttaggaagactacatttgaatataatttgagaggtgaattaaggtttggttaaaattatatagcttctttgggaggaggaggatttgagaaagaacaacgcatgtgctagtgcaggggtgtccaatcttttggcttcgctgggccacattggaagaagaattgtcctaggccacacataaaacatattaacactaatgatagctcctgagcctaaaaacacacacatacacacacacaaaatctcatagtgttctaagaaagtttacaaattttggggggccacattcaaaaccatcctgggccacatgtggcttatgggttggacaagcttgtaccagtatatcagggcccgaggccatacatgcccccatctttcctacttatctgtcgatgaactttgcctcatccctagggaccaaacgcaaaggtccctcccatgagagtctctatcatctcagtgtccccttcaagacatagtttagagttaaaggttctccataaaacaactgaatgcaagagtgaatgaatgaatgaatgagttctctcgcccttgatggccctgttttctgggttctccctcctctctaaatatttccttctcagtttttttcactgctcctcttccttcttatttgtcttaaacagagatatgccctaattctatcatcagaccctcctcacttgcagggacagggggaggtgaaggggtatctaaactccatctcttataaatgcttcccaaacccacatctctagcctagtcttctgccttgaaatgcaaacccatattttcaaatgccaaacattccttctcctcccaaaaccctgcctccctcgtgactgtcacaggcattagaaatgaccctgtccccaaagctgaaaactccaggctctccaatacctccaccctcctcattctttaggttcttagatgttcctgtttcaaggcatcttcttatattcctttccctgtctattcccactgtcatcaccttaattctaccttatgaacagtctcctaggctttcaaaactgactcctaaatggtgggttcaggatttccgttcacccatatattttcatacttcctagacacttgaagcctgattaaaaaacaagccaaattaccaaaaaaaaaaaaaaaaattagtataaacatctaattttctttagggaaactggcaaggaaactggttacagagagaataagggttgggattgccccttgggaagcccttgttactcagcaggctgcaccagccccactccgactctcccacacacaaaggaggcagagtagcccgaggattgggagcacaggactgttggccccctgactgtgacttcctgtaaggccttaggcagagtaatccccttcctgtgactccattgcttcatttgtaacaaggggagattaataggctcagctttaccagggttgttgtgaggattaaaggagttactacatatcaagaggttagaatagtgcctgccccaccgtgggtgactgataaatgttagtcatgatgatgacaacaacaactatctacttagtaaagactgcaatatcccagagcagagttcagactggtgggatcaacagtattcaataaaatgacctagcaacatcattaactctgtgttccaatcccctgagagggacatcacattgtttctttcaggaatgcatgacctttgtccaatcatgcgaagatatgggaagggtctgaagtgagggaaattcagctaaataattgatcaatactcttcaagggtgccaagatcatggtagataaggaataactaaagaattgttgcaaactgcaggacactagggagaaataacaactaaatgtaacataggatcctggaatggcaataaaagaacattggtagaaaaactggtgaagtttaaatgaggactttagtttggttaatggtatctactgttttagtccatatttgtgttgctatcaagaaatacctgaggctgaggctggataatttataaagaaaagaggtttatttggctcacagttctgcaggctgtaaagaagcctgacacaggcatctgctcagcttctgatgagggcctcatgctgcttccactcctggtggaagaggaaggggagccagcgtgcagatcacatggtgagggaggaggtgagagaaaggaggaggtgccagtttcttttaaagaaccagctatcatgggaactaatagagtgagaactcacccttatagcaccaagtcattcatgaggaatcagccctcatgacccaaacacttcccactatgccccaactccagcattggggatcacatttcaacatgagtttttgagtattacatatccaaattatagcatgtgccataccaggcagaaatggtaatttcctggttctaatacttgtactcaagttatgtaagagaggaacactgaggaaagctaggggagagacatacagaaaccctctgcctgatttttgcaaattttctgtaagtctgtaagtagttaaaaataaaaatctgatccttcacaaaagaacactaatgcagcttcactccaaaatcattccctaacagttttgggtttttatcatatactaaggcattactagggttcatggaagcatcagtgaactggacatggttcttccttttgatatttcacagtctagtgggaaaggcagtcaagtaaatgaatatttagtaattgttatgagcaatatatgcacaagtagggaccttaatccagtccagggcaggaaggactgaaagtgaggatatccagagaaggtaaaacacctgggctgaatattgtaggacaagtaagggttagtcaagtgaggatggaggaggaaggaagccccagcagtgggggagtcacacaaacacaggcacagagcccagaagctggctgttcagcaaagccagagtttaagctgactgggagaggcaagtgagaaaggaaaagtaggtgataaggtggaaaaatgtaggcaggggccttgtaagccaggctcaagactttgtactttgtccttcgggcaatgcagggttctgaaaggacagacatacatttttctaagatgatcctgagagtagcatgaagaatgaactacaagaggtacgaagctgggagaccagttaagaggaccaagccaaaggtaagagcaatggaaatgaaagaacttaggcagactcaaaagtgtgtagagagagagaataaatagggcttagtgatatattggatacagagggtatggtaagctgagtaacggaccccctcaaagatgtccacctactaattcccaaatcctgtgtatatgttactttacatggcagaaggaccttgcagatgtgaatgagttaaggattttaaaatgagaagattatattgtattaactaggtgggcccaatgtaatcataagggttttgataagagggaggcaagagggtcaaagtcacggggcaggaaatatgaccacagaagcaagggtcataaagaaatttgaaaatgtttcagtgttggctggaaaatggaggggggtgccacaagccaaggagtgcagctggcctttagaagctgggaaaggcaagggaatgaattccccctgagagcttccagaaggaatgcaggcctgacaacatcttgatcttagcccagtgaaactgacttcacacttctgatccccaggactgtacaagaatcatgtatttgtattgtctaaaaccactaagtttgtggtaatttgttaccgcagcaataaaaaactaatacagggagtgatggagaaagagaaattgatgaggttcccagtgtctggcttgggttgggaggtacgtggtggtgacagcaagacaaggacacagggggagaatagttgggaagaagacaagttccattctggacaggctaatcccaatatgtttctgcaacccacaggaagtccactagatggttacatgtatggtgctggtgctcaagagagaggtccaggcttgggatggaattttccacaaagttgccactcaccacttggtatatacttaactaggtctaccgagttttcatgttttaatgaaaaggttagcttcaggagtactactgttactattgctatggttatgatatatgctatgaggagtgactatttctacaggcaagactgagtaagggaaagaacaatacttatattctaatagcatggcagctatgttaccctgaggaagttacaaattctctgtgcctcagtttccttatctttaaaaagagaataaatcctgaatgggattaaatttaaaatgagtgcttggcacttagttgagtgcccaacacaaagttaagtgctcaataaaggggagctaagtaagaacagcttatacacaacccattaagaatattttgataaatcataagaagttcttaagttgtccaaaaagctgtaacaaattgtaattccttccccagtcattttctaaatgtatcgaatacttcatttgctataggacattaaaagtatagaggacaggccgggcacggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcaagactccgtctcaaaaaaaaaaaaaaaaaaaaaaaagtatagaggacattatctctgcttacaatttgtgcacaattatgacaggatatatatcaataatgataaagaacagtgtgcaagctgctggtgatactaaagatgagtacaatgtgattcctgccctcagggaatgcacagtcttgagagaagacagattagatatagatacagatatagatatagacatatgtttctacatgtagactaacatttattgtgcacctactaagtgccgagctttacgagtatttaacatgtattacatttaagtttacttattgaagccctgtgaatcagatatttcccatacagtagaattgtctccataacattctgaagcaattacagaatgaaagtgggatgatgaagataaggtttgtcacatctcagaacaaacatcagtaccccaataagtgacatgtaaaatgccaccaggcaaggtttgatcctgaggagagaagtcaatggtttgcaaagggtgcatgaacttgctttacaaggagaccaactgatccgagggcaactcttgcttatcccctcctcatttttcttcaaggaaacataaatgatatttgctgagccaagcctgtgcaaagtgctttgcataggtcatgtcacttgagaccaaagagtaaacccaagcaggtgaatgcaaagattttgtagcaggcagagaaaactgctgattaaaattctattagaccgcaagtctcctgtaaatttcactagcattcccaggtctcttgcaaaagtgcagaacagctactagaaatatgacaacaaaggcaattaacctcataaaacaatgcagatgaaaaaacaatgggaggaaaatgattaaggttaaaataagagagggaaaccaacatattaagagaaagaataagattttaaatgaggtcataatagaaaccagatgagaagcccaaatagaaaaggaaagtttcaaagaaaacaaaccagaaagaaggaaaggaattgggtgggaagaaatgactagaagttattttgactttctacaaaacaatagatggtatgctggttctcatttctgaggtcaagtcccccatgaggtctcaggcaagttacttaactgccctgattaggtaataggacaatgtcagcacctacatctcatagagttgttctgaggaggaactgagtacagcactgagctccatgcttgcagctagaagatcttccatctaacagtggtgctgctgctgctgctgctgctgatttatgctatcaacagcatcccaccaggacctcccaagatgagattccatgacctctattccatgataagcccaacaaccctcaaatgttccagtgccacacagattcctcaggaggcatctgtgatttcaggaaatgtggtcattttagatcattctctctaagtcctctatgcaatacacatttgtatctgcagggcaacaaagcaaagagccaccatgcaaagataaccacagcctagaaaaagaagaaaagataatgagttattcacaaaggtttcctgtcttctggaaaagcctgtgtcattgtgtctcagaagtccccacggtcagcacaaatatcctcaaatgtccactaaatttcatgattgctctacctgtaagggttgcttaaggggcatcccaacaatacccactgaggtttgtgcctggcaggtttttaaggcatctcaagctttcaatgtgcaattggcaaagatttagccatcgtgcaccattctgtcctttaaagcagctaaagcttgaatctttgaaatcatctaaaccttgacatgcatcatgaaagtattgcaacagagaccactgacaggaacaccactgtgtatcatgaaggtacagtggaacacctacattaagagtcatttctcggccgggcatgatggctcatacctgtaatcccagtacttggggaggccaaggcaggaggatcacttaagcccaggagttcaagatcagcctgggcaacatagtaagaccccatctaaaaaataaaaaaataaaaagtcatttctactgtctaaggcacaatcagagtttgcctcttctttgctgtgtggactctgccagaatgacaaaggccccctccaccctttacaaataaatcaccttgcaatgtattctatttgaatatggatgagaaaaggagcattttaaagaagatcatttgtctaaaccaggattactttctagcacactaaaaagtgcacataggtagtgagggagctcttaattccagattcaagtgattaaatcataaaagaagttgttgctttttttaaggaactctttggagaaatatttttaaggctggacaagcggtacaaaaagaaagcggcacagataaacctaaaagaaattaagcttagagtggcagctaatctccttaaataggtttctgagtgcaagatgtgttaagtgttgataagcatttccttggtaaatggccactggccccagtgtgtggcactccaagaacagaacccctgccacaaatctgcaagattctctgcaaaaaaagaactctgcttcattaataactttttaaaacatgcactaactaattcacactggcagttgaaatcttcccatcaaaattcattctacaatcaggctaagttcaaagatatatgcagggtaaagaaaaaactcaagtttagagaagatttggggtgagtggtgtaggtgaacaaaatcatatagtctgaacttaaagttttagagtcaggaaaataggataaaactagatagaggacttggtcaagtgggtcaaaaaataaaggtttcaattgcataaaaagccaaatgtgagttcagatttttaacgtgttatgcataaatacttgctgctattttaatatttgccttgacttgagctgtagtgggactctgcctgaggcaagatttttaatagcaataataaaaatacttaatagtacttagagcaaagcatgtgtggtcacaatgttttaaagggggaaagaaaaggtaattttgaacatctgcactgcatttccacatgataaaaccactacactccaaaattattccgaagtttggtggtgctagaagcaggggaggaggaagaggcagttcatgtagagaaatgtttgtttaaaaaacagaaagggagacacaaaggccatttagggaaaagcagggatgacaacctttactgtaaaataaaactgccaattaatagtgagagtccagtaatcaaaatgtaaggcttatgtgtcttctcagatccataattattacctccataaatactcctgagaatcaaatgtcttttattttcacaaagtcccaatcttcccatgtggtatatcagataaaacaccacccccaacccctcctttagatttcttttgcaggacttgcctcatttccagccctacagtttctgagagagaagagtgcagttggggtgggggagttggaggcagcttctctctcaatctctccctccatctgcctgtctctgtctctatcaatctcaatcactctgtctctctctctctctctctctctcacacacacacacacacacatacacacacacacacacacacacacacacacacacactcttatgtttctttttaggctcaagctcccccccatccctacctccccccagcacatctgctttctagttaaatcccctggagtcagactccgggtgaagaagtctcctgatctgggctgtccttcctcaataaaaccaagtttcaagcagatggggctaggagttactgtccttgccacagccccaggccagccagcagaacggatgggtcactctataccagcagttcaccaccataattattttgcaatgtctggagactgttttgttgctgtcagcacaatctggggaagagtgtaagtgctaattgcatctagtaagcaaaggtccactattcgacatcctgcaatgcacaggacagccccacacaacaatcaccttgcccaatcgtcaaccttgctgagactgaaaatccctgggctacaccaagccagcaacatcctagtaacaggcagtcttcccccaatactaaaaatgctcaaatgtctggcagcccagctcaaacagatgcgagagatctgattgccctgggggcaggaagaagggcagagagtgataagggaactggctgtcctcctgaccaaattctggcttagctgagtaagaccagtgtccatgggcaaacctggcaaggccatggcacactaacaactaccacatgtcaatattttttaacacaacctgcagatatacacagtttctttttcaggtcagttccttcaaagcagccacattttttaaagcactaattgtgtagggctaaaaagtgtcaataaacacaggtatttaaaaagagaaggaggaggaggaataggaggaagcctgtgtttttatcaggtaaggaagtcctaattcttttggagtttgaatggcaatctccacttctctggtgattcttaaagaagtctttgttcacagtccctttggaatctgccggggttccttcccaaaacacaccactcctaaaagaggtgcagactttcgtgataactgacaatacccaatgtgttaggaatcagagatcaaaactacagatctaataactgtgaaagaaaaataggtggccgggcgcggtggcttgcacctgtaatcccagcattttgggaggccgaggcgggtggatcacttaaggtcgggagtttgagaccagcctgaccaacatggagaaacctcgtctctaccaaaaatacaaaattagccggaatgtggtgtcgcatgcctgtaatcccagctacttgggaagctgaggcaggagaatcgcttgaacccaggaggcggaggttgcagtgagccaagattgtgccattgcactccaacctgggcaacaaaagtgaaactccatctcaaaaaaaaaaaaaaaaaaaaaaaaaggcagaaaaaaataccgtttcctgatttaaaaaccaacctcaaaagctatatgtgaaaacagtaagatttgatcctctaaatataactaattgcagacaggcttttaccaaatgtcttgattcaaaaaactacttacttatccttaattcagaaagctacttacttattatctaattcaggggtcagcacatttaaagaggcagatagtaaatactttaggctttgtggaccaagaggcaaaataaagggtactatatacgtacttacgtaatcctttcaaatgtaatcatttaaaaaggtaaaaaacattcttagctcccaggccatttaaaaaaaaaaaaatgctgcaggccacatttggcccataatctatagtttgccaaatctcaatctaaaaacgtagcaagtctttgtaatttttactcatgaagtctcactcacctttctttttcctttttctacaaacaacttatacagaattatatttttcctttagtgagaatttaattcattcttatatgttatagctgctgtaacgatagccactcctaggaatcacccattagcagttcacattgcctttttagcgctctatccgaaacacttaagagacccctcaacctacatgcctaactggaaacccaaataaagtagccctttcacatctgagccaaggtggaagggaaagtagattttaccaaattagaagagcaatgaaatgcacatgtcttaggagttacaaatgcaatttccgtgtctcacaattgacacagaaagaaacacaaaatactcaacaaaaactaggtaaaaagtaaagttggttttgggagacaaagcatttctttttggcagtgagatattcaagaagttaaaaaaattgtaaaataaaactaactttgatgaaatgggagaggtctaagtgccacacatttgtccttattctctgctcacaaaaattcacctatttgtgcagaatttatggagggccaggtgctttcattttcatgagtcaaaaatggaatgggaagacctagccctgacgttgccttctacatggcactgtttaatcttcccgctgctctatgacctcacggatttatagtccccaattcaacaggctctgataagatgtggcaagaaaataaatcagagccttttgcatttcttcctttttcacatttatgagaaaataaccttcagcaagaagctagaagaccagaatcctagtctgtggtctactctggattacactgaaatccctggcagcatcaagaagtggttaggaacaaggtacttcaatcggcaagtccaaatttgaatgccagatccatccatcactatgtgctctgagaacctgggccagtcacatcacctctcaaggcctcaacttccccacctgagaggcagagaaaccattgttccgttcagagtatcgatggaagaattaaatggcactccttgggaagtgactggcacaggctgcccttagtgagtgcccagtaaatgttacatgtcatcactgcttaatttctctgagtctccatgtcctcccagggttgccaaaagtatctgaggaaatagttaaaacggaatgtgttttataatggaatgtgtttataggctttatataccaagccgcctccacatgtaaagtattaatgtttccactcaagacaggtagggccttggtatagctgagcctgtctcaactacccattgctgcagcttatgaaacatgctaacatactcacagagcctgtgcttggggtactttctcactgctgaggttttatttgtggggcatcatcacaaatgatgatgatgataaattatgtcagttacccaaaaaatatttttcagagcgccatcacacctaaggtaaagcaggaggatgagggtgaagaggaagtaatcagagcctctctcagcataacctccggacattctcactcctccctggtgcctccccacacccccaaccctgtcactttcttttctcagcaggtttcaaaatgccttgtgtctaatggctttctggggctccaccagtctctgttaccgtaaaaagcagttgatgatactcattgaaatgaaaatggagtaattagcatgtagcattcaaacttaaaagaatgcatgagaatttaaagataaggcaaatgatgctaaacagaaaggaatttattttccgtgtcatcagaaatgtgaggataaaaattatgaaagcctacttttggatgcactgtcagattacagagagagcgcttttctggaaagatgcttcattgacatccatcctgcatggagtactcggagaaaatggaactcagtgaaaacaaagggaatttgtctcaaactagcatcagtcaatgaaaattccacataatctcaaaagagataccatattcaaaatcagatgcttactcgggaaagaggcacaaaggagaaacattcaattctagtggttaaatactagtaggagtaaatgaaaaggcatgccttagaatgctcacggccttggggcgtggtggttacaaattatcagatgtgtgtgaaaaaaataaataaaactgagcaatagtcagaaatgccttgtgtacttgggcagaacgtcacaatcatttcttcacccacattctcaaccttggctgcacggctccaccaagatttcatcaaactcaacacattcgaagtcttccctcaaccttagctcctcctgctgacaacccttgcctgcccactgctgtaccatatctgcctgcacacaggtctacagcagttgtctcttcctcctcaaatctcccagcactcagttcttaagttgtcaaggtcctgcctacaggtggagatgacctttcccttcaacttccatggccaccacccagattcacactcttggcaacctgaatagccacagtatccatctaacttctctccctgcttttgttctcttcccatccaatccactgtcaactgatcatcttctctggtcatgccattctccaggtcaaatgccttcaaaggctccccagagcccacagagtaaagccacttccctgtgtgtgggcctcagagccctcagtgatctgagaccaaaccatctgctcagctttatttccttcccccactgaaaggcagagtttcagctgctccaaactcaccgtgcctcaaactctccacagttcctacctctgtgatttgactcagtcatctgctctccaatcatgctttcccaccaaccccatgtgctaaaattcctcctgccttgaagactggttctaccgtggatgaagccagttgtcagctctcctacctttaagctgtacagcatttggatgccattcaaggcctctcagtgtaccaccccaagaagcagtagcatgcaatggggacaggtacagagtctagagtcacactgcccagcttccactcttgattgcagcttttgcagtgtgtgactggaggcaattacttacctcactctgcctctgtttccctatctgtgtaatacacatgatgacaacagtatttacttagcacaggacaatacttgataattatgagctgttcctcttattgctcacctgaatctctgaacaagaccacaaaattgccactgatactcccacagcatcctccatagggatgctcaacatatgcccaatgatgtccaacacattttagaaaaaaatgaaagaagactgccagttaaagctacctgcaaagtttcttctctactccaaacatagagcaatgatgcagaaaacattttttaatggagctcataccaaccattatgaattcttctgatactgacaaaataaatcacagagtaattctctagatatttttaacaaatttttcactcattacaatatttattgagcagctactggcaatatctgaggtctgggaatactgatggaatgtactgatcaggtaagaaatttactgtattaaaatagggagcaattgttaagttctgtaatatgtataggaaacagcccttgtaaaagatcgtgtatataaaatgttatgtttatatgtttgggaatagtttctgtaattagctttgttggtagaaatagaatgtattgaatctgtagagacagaattagaaatgcctgcatcagcaaaatcatggcttaggtcagcagaactagggacaagcatgtattaaggaaatcatgtggttttgagaagggggaccggaatggcatttagaagtttgggcagagattatacaggacaagtttgagccatcagtaaaggtctgaaagcttaagaaattccaggtaataccttttgccttggtggatctcccactgtcctgggttcaacctggataaggagaccaggagaccaataattcatgttacctctttctcctgtctgcccacccccagcacagagggaggcccaggtctcctgggggttttgcttgtcctgggttattagcaactgtggcctgtaaagacttgggtgctcttctggccctgctaccaaagaagggcaagatgcccaaaaggattaacacaggacatcaataggattagcagcagaacatatactgcttcccatcaagatcttacagcgagataagtccaaagacccctatctctcttctaaggaccagtcaagaaaatagtaagcagggtaagtataagaggatcttggtctattaatccatttctttttctttaatgagatcagttgtgtttcaaatacttgatcgctaaaacttctagatggaacaatatgttctttgcagaaaaagctagagaacaaggtaaacgtcaaacaatgtcttatcaaatcaacctgcatccaaatacatcagacaatgctagtgagtaatgctgagtttcggccaaccctttggctcacattagcacatcagttggagttcctgcgcaatggttttggtcttccaagtaagttgagatcataacctttttgttgttgtttcctgccagacaaagaagtggtttcacactcagccttttccagaccaccaaaagacaataagacactaaagcaacccaccccatatgcaactcctgccaactccaaatctcctaaaacaataagctgaacaaggccaggagatggggtttatgtgaggtccaccacctctgcctaagaatgaatcataaaaccactagcactccattccccagcttcacactgcctagccccaacctactcgaactgtgcataatgaaaatgaaatcaggaacacactgaacctaaaacctcaagtacattttaaatcttgttttagattcatctatattaacagaggtcaggcaatttctttattcaagctaagttattcttactggtataatgacaaaagtggtcagacacattctttctactaaaaaaaaaaaaaaaataccctgacaaagtacattctaaaactcagtagagaatatggaaatagcttgcaataaactttgccttataaaataactaatgaaggaaataacccagttatttggcaatgggaaacaaccatttgtatattattacgtatttggtaggtcattaattagaagcactttttattttctagcatagcatttttcaaaaatgtcttacaaagaacaccagtgcaacaagagaaaagcaagtcacgtaagtttgagaagctctgccttctctggtccccttcttggaaatgactaatgcatatttgcatattaaagactgagactgtaactctgtggaatccctcatttccccaagttcacttggcactgcaaccctttttctctcataacacatatcaacagcccacaaaatggctgttctgccaagcacaatttggggaaaatttcttctagaaatgggatgtaggccaggcacggtggctcacacctgtaatcccagcactttggaaggctgaggcaggcagatcgcttgagctcaggagcctagcctgggcaacatggtgaaaccccgtctgtaccaaaaatacaaaaaaaaaaaaaaaaaatagccaggcatcgtggcacatgcctgtagtcccaactattcaggaggctgaggtgggaggatcacttgaacctgggaggtagaggttgcagtaagccgagactgtgccactgtactccaacctgggtgacagagtgagaccccgtcccccaccgccccccgcaaaaaaaagaaaagaaaagggacatagtaaaatggtttaagagctgagactccagagtcaggctgattcaaacactagcttcaccatttgttagcagtgtgacattgggtttgtccctctgttcccccaggtaagatgggcaaagtaacagcacctacctcctaggccatgggtctttccatctgagtggaacagtcttctgagatcctcacatggctggtccttttggttatgcaggtctcagttcatactgtcaccccctccaagaggccttccctgacaacccaacataaaattagccccacccacatcaccagtgcttcactctcttcttcatgacacgcctctatttaaaccataaaattgtcatctattttcccccaatagaatgtaagcaccatgaaggtacattttgttaattatcattgctatatcccaaaacagatcttcaataagtattcatccaacgaaggaatgaatggatggattaatgaatgaatgaatggatggatgaatgaataaatgaatgaatgaatgagatgattcagtgtgaatcaacgtaaagcattcttcatgatgcctgacacataagctgacacatacagatgctattttgaaaacttttggggaaccgtgagtggttaatacacacataatcataattctcccaataagtaacattatgactccacagtgtatcctcttgctgtattagaggtaaacatttcacaacattcattcagaggtgtgccagtaaaccagctttcaggaatgggcaagggaatggggaaggtagtccctaagagtagcatcttccaatttccatggtgtaaatacaccaaatatgaccaattccaggctacgtgtggtttaacaccaggatcatgagattcctgagaatttaacaaatggctctcacagggcagtacaacccttctcatgggaatgatcctttcaggccttcaagtcttgtttgctgagttcaagtttaacatgagtcttttatatacagatgtattttccaaattctccccctcttgatgagctaaaataagggctacctactcactttggtctgatgctcagggaaactagttgaatgtattggtctgcactttctgttctcccttctgtgtgctttcaaactggtgtttagggatctaaacatgatctatatccacaccagaccattgtgagaaccagccaatctcagaaaacccaagatgaattgtgtttagattcatttaaatggaggcagccacataaggcaccatctagtaagtgctatcaatgagcagaatctaattgcagaagaagaatgactccaccctgaccacaagatcccaacaaggagtgagaaatggtgctgcagatggagatttctctggcatcacagccttgctgccccttggcatcaaaataaaacagcagctttttccaactatagtgatcctctatcaactgcagttttgagataacacaagaaaaattccaaaatccacagttagtctacatgcaagtaacaacatgccagtaattgttgctcctcttctgtaaactacatgagaggtctatgaagtaagacatggagaaaattactttctgctctactgtatttgttatctattgctgtgtaacaaattaccttaaaattgagcagcttaaaagagtacacatttattatctcacagtttctgtgtgtcaggaatcaaggcacaacttaagtggttcctctgtttcacagtctctcacagcctgcaatcaagatgtcatcccaggacctgtcttcttatctgaagctcgactgggaaaggatccacttccaagctcactaaatggctgttaccaggtttcctttctttgtggctgttgaaatgagtgcctctgttccttactgagtgttggctggaggccaccctcagttccttaccacatgggcctctccacatggcagcttgcttcatcaaagcatgcaagctatgaaggcaatagagtctgctagtaagatggaagtaacagtcttatgtaacctaatcctggaaataacattgacattctgttaattttgccatattctatcatttaggagcaagttatgaggatcaaccaatactcgaagaggattatataatggtgtgaattccaaggagtagggattattggaggccatcttggaagtcttctcaccacattcaccctcttggaagatggatgggaagaccaggcccaaccaaaacatctctttaagcttttcaatatgaaaccaagccatgtggtttcccaagcatgttggtaaagtatcattaaaacgaaacaaggaagaataggagtagaggacattaaatttgcagacacaaaagtcttttcctatgtgctaggcaaatataacccacatcagagcaaattcctgggagcatctgcacttttgcaaatcccaacatggaagccatgtcttccgaccaaccaaacaagtgactcacaagaagcaccaccatctgaacaggtatactgccaagaaatctagtttggtctagaaggaaatatcttctagaatttttatttattgctatagaatagtttgaaaacatatttaatgccattttattgcttgttattttctgtgagatccacgtctccctacagcagttttgcctgcatgatacttttaaggtccatatccaccacagtggcaaggaactgctattaaaatttcaaaccttggcagtcatccacattttttctaagctctacccaaccacatattctcagatacacgagcatcccaacattgaatggtggtaaaaggccagagagactgcctctgaaggacttcaaatgatttaatctactaagggcaaaacacatactcagaaaacctgtaatactctgtcctagacaaatgtaaatgcagacaaaaattatcttaaccctaaacactcaaaattggtctgtgcattttaccattctttcccataggctttactttctgcaaatctcatccccaattcagtaataaaaatatttagggtcattgtgttgctaatcctatttattttttcctttagagagatgatatttgataaacaactaaactgaatagtaccatacctaaaagactctgaaaccacagccacctgtgggaaagcaattgtttataaaccaacttacagttgatatgtcctgtatatgcttggatcgcggatatgtgctgaataataatggaatgcatgtgcagtgagcaaagactaatacaaaattccagtttaatggtcttaagccggcaggaaggtcataaagcagatgacaaagggaattttgttaaggatgtagatatcttccaacctgtgaaaataacttgataacatattttcacttataaattaaggctttggggaaatacagtgaatgctcttacctctctaagatgtatgttttccttctctttctgatctaaaatcacttccaagtggctgacctgagactcagcctctgccatccgccgcgttcgctcattgtcatcctccaggcttttggatggcaagcctttactttgcaacatctcaagaagttttttaattgactcatctcgggcattgagggtttgtttctgcgtttcaattctcagctccatttcctctaatgtcttcctcaaaaggaacagctccttagcctgcctgtcatgctcggcttggagccgcctaaagttctcctcggtcagctcgatggtgaagtgctccgctcctcggttgccactctcttgctggaggaggtggttgaggtctctctgggttcgcagctcatcttgaagggcctggattgtcaactgtaggtgctgcaatgagaaagatggagcgggagaggagaaagaaggaaaaaaagtcaatgaaaatgtcaagtgccgcttgctgccaccacactatgaagatggaatgttaatcatgaggtccggagggccagccatgaattcctccacggtgacttcagaagcatgggacagcacatggagagggggagattaattcagtgatgctttctgaatgtcttgagagaagagaaatgcacacacacacagaaacaatagattagtgtcaatcacaagggaaattatacatctacagagttttaatttaggaaatggaaaaggttagaaggaaactttcacaaacacaccttctttatgcccagaatgctccagactcagtattccttgtttcctaaggtattctttattgtactatccattatttcccacgatcaatatgtggtgatttaaaaatgaaaataatagcatccactacaagtagacacaaacaaagactttattttttacaaataaagctgtgaacaggtttagtaaacaggattactgcatctgcaagcaaaagggaataaatgcaggcacagacaaacacactcaaacacacaaggaggtgaggctgcacagagcagaacaaacaagctgcaaagagtggacaaaccttggttcttctggcatccagtaactgaacagcatggtaaatgaaaaaaaaatgaagcaaaaaatcaacacaaagaaaagtccagtgcaagcaaaggatatttaacagaaagaacttaacacaaagtaccttcacagaagaagaaaaaaaaaaagaaaaaaaaattctaattacagcaaagacccataagctacatggagtttatagcattgacgtttgatagacatggaaaaaaaaaagaaagaccaaacctgaggtttatcccaccttttgttttcctaaatctcactgacccagaaacagaaagtcttgaaagtattactagagagggaagcaactgttattttgggtcaccattttaagcaaagtcagagtgaaagcaccagagaaacaaaatagttatcagatgtgagaaaaggcacccgtgcttgaagatagttgatgaatttggcaacacctttccccataggacaaacccccaggctggtcagagaaggcagccacaagcctgaaggcatttctatccctatggacaagccaagatgcttccaagacagcagctgttcattcgccaaacacatgatcctgcttgtggaatgaacacagtgctaagcacaggaatcaagagggacataagacatagctcctgcccacagggaactcacagtattgtaaggcatggggtaatactataagttatatgaatattggagcagtcaacattttgaaatctttctgaattcctatagctgacactcagaggtattgagatctttctgagtgtggcctacacccagaaactagcactgggtgatgcaccatcttgattatattgtttctgggtatccaattcatattcccatttatgaatgtccattgagaaattattagagcattctcatctgtataccacagtgcctctcagggtattgaatgcagagaaagaaactgatatgtatttaatgatggaggttattcatttttaatacaatgctcccctataaagtgtaacatacaaagttgtacaaccatcaacacaataaattttttaacattacctcagagacacctcatgccctttagcagtcattccccatctccctccctttccccaggccctggtaaccactgatttactttctgtctttatgcctgttatggacctttcatatcaatggtatcatgcaataagtggtttctttcacttagcatgtttccaaggtttatccatgtggtagtgtgcatctgtacttcgttcctttttatggctgaataatattccattgaacgaatataccacattttatgtatccattcatcagttgactcagacacaaatattcatagcagcaacattcatattagtcaaaaagtgttaacaacccatttgtcaatcaactggtgaatggatgaaatctagtatatcaatttaatggaatattattcagccataaaaaggaatgaagtgctgacatacaggataagatggataaatctgaaaacattatgccatgtgaaagaaaccagtcacaaaagaccacatattgtatgattccactaatagaatgtccagaataaacatatccatagatggagaataaattagtgattgctggggggtgtggagtaaatggggggactctaaagggtatggggcatcttctagggtgatgaaaatgttctcaagttagataggggtgtcctttgcaccactttgtgaatatactaaaaccaacgaatttcacactgtaaatgagtgaattgtatggtacataaattatatatcaacaaagttgtcacaaaaatcatgaggtgggaccataaagtaatctaaccttcctctaccaacccgctgtccttaaaccacattagaacagagtccacaggagtatccgcagccttcagcccagagatgcggctgcagccaagactcttgaaagagtgctttggcaactgtctttgaggcattttatatatctatatatatatacatatatagctagataggtagatagtttttttttgttttttttttttgtttttttttttgtttgtttgttttttgagacagagtctcgtcctgtcgcccaggctggagtgcagtggcgcgatcttggctcactgcaagctccgcctcccgggttcacgcctttctgctgcctcagcatcccaagtagctgggactacaggtgcccgccatcacgcccagctaatttttttgtatttttaatagagacagggtttcacagtgttagtcaggatggtctcgatctcctgacctcgtgatccacctgccttggcctcccaaagtgctgggattacaggcgtgagccaccacgcccagctaatagatttttttttttttttgagacagagtctcactcagtccccaggctgaagtgcagtggcatgatcttggctcactgtaacctccaccttctgggttcaagtgatcctcccacctcagcctcccaagtagctgggactataggtgtgcgccaccacactcagctaatttttgtattttttgtagagatgaggtatcaccatgttgcccaggctggtctcaaactcctgagctcaagtgatccacctgcctcagcctcccaaagggctgggactacacttgtgagccactgtgtccggccgtcatttaaatattcttgaccatggcaaatctttgtcctttgaaggtggcttggatttctgagatgatccaggtttatctggagtcaaacatcatgaattgggatgatcacaaaggaaatgatcttttctgagcataaccaaaaataagattggtcttcttaagattcgtaaaccagccagaaggaaattccaaagaaaaactgccaaatgctttgaacagaaacagcaacattggaaagaccactctgtgagggagctgcccctttgaatggacacattccttattgccctgatcctttgtccccacatctacgcagtggggataatcataatgcctactatagggttcctgtgggcaataatgaagataaggtggcaagtgccaggtttgacagcaacgggagggaggaaggatggcagaagtgaaggaagataagaaagaagaaaagcaggaaagaagaaagggagcagaggagaatggagggaaaattggtccatttatccattcaatatacagttactgagtatctccctcatactcatgaaatacaaaaaaaaaaaaaaagaaaaacaaaagaaaaaaaatagcccatattcaaagtctatgtggacaagtaaaccaatagaagcaacactatgtcatgagggttacaatagaagtcataaccaggtggctagaaatgcagagaggagggaacccaggctaggggcatgtaggaaaacatcccaaaccaagaggccaccaataaactatgtcttatttgaagggcaaatgagagtcatccctgtgaagaatgatggaaagagaagagaaactgtaaaagcaaagaggtaaggacagaccagatctattaagaaacagtgaaagcaaaaatctgtatatcatttgtaataccacatgccatgcatggtcctaaggtgtcttaatcctcagaaccaccctaaaaggtagcaactgttatgatctccacttaatgcataagaaaatggggacaaaaagtacttaagtaacctgctcccagtcacccacctacgtaagtggtacagccacaggtgttcatccaaacactttgaccccaatgcccctgttcaaaccacgacatcattggcctctgaattgggacaaatgcttcaagatggcaggagaaaaggatggggaggggagaagtagtaaaagcagacaggtaggcatttataacagaaatagaaattctcaaaaataagaattagccatcttggctgggtgtggtggctcacacctgtaatcccagcacttcgggagatcaagatgggagatcacttgaggccaggagctcaagactagcctgggcaacatagagagaccccatatctatttaaaaagaaagaattagccatcctaaccaggctgttccttattcagaagtggttacgatggatgcttccaggctgtacatttattaagaagcaaaatctatttttcaggtagtcacactattagtcactaaatgacttcagcatgatgaagcaatctcataatcaccataaaatttagtgttcaaaattttctcaaattcatgtttatattttcattttcttttaatttttcattttcttttagttttcattttcttttaattttaagatattcaaaatcaaataggaatcttgttcctacaaaaaagatttttgaggaaaatacataccttgtagatccttgatcatccttttgctttacataattgaagacggggaggggatgtgaagtaatcttatccatcctccctctcccctcttctctccccctcctactctcttctttctcattgttctactttttagcaattcaactcaatcaagtttcaaaactcatttaccaagctgggcacagtggcatatgcctatagtcccagctacttgggaggctgagaggatcacttgagcccaagagttcaagactagcctgggcaacatagggagaccctgtatctaaaaaaaataaaaataaaaaaaaaaattaccagattttcagttatgtatttaacatagacaatttcaattataaaatataataagagaaataatccatagaaattgataaactttctgtgcctcggtctccccatttgtaaaaggaggagagtagtaattccttctaccttggaatcattaaatttaatgaggataaatcatttaatggggattaaatgagttaatacatataaagctctagaaagtaccacatgcagagtaagacatcaatcaggataggcttaggatatgctgcagtgacaatagcaacaaaaaactatattcagaaagacataaaccatctgctgccagggaataggaacattcagaactcaaagaaaccttaaagactgccttattaacctcattttataaacaagaaaattgtatccacacagatgaaatgacaggctcaagagcagatacacactgacaaagccagaatctgggtttctgggatcctggactcagtcctggtatgtatttcaataaccctaagagtagaccaaaagggggtaactgtacactttgactaggaactttgacaactgtacactttgacaatgtaggaaatggccatggtgtctctgacaaggaggatgagagatacctaagtcacttcacttccatgtcaccgggtcctatccagtagttaaatcacatggaatgatccaaggacaatttatttaagacttcttttctaagtactcagaattagactgtgtaaatattggaagacatattcaataaaaactagctctaaaggaccaggatacaatacaagtgaacgctctagcaaagccacagcaccttctctctgagtgaaaggtacgaaaaactgcagttttcaatttcctcctccagagggggttccttcaagccaaatcatctaccctttcccaactatgaaaacacacttcttttaagacagtcacccaaactccactggcattcatttcatcttgttacctacagcaagtacctacaaaccagaatttgcatgactgtattctagggccatctctttggaatctcccaggcatcactgtggtctcaacttctgaaagcttcagtcattctttctgtggcttccattccactgcacatcaggacagagaccttccaatacccacttgcactaggaaaggacattaccaggtgatccaatctcatgcctgggtcccagtcaaactgctgtcaacttagcacttacagcacagcttagcgcttatggcaaaacagctaattctcctcaagtgcaaagtgagtctgtggttgaatgagggctcagaaaggtttttactcgccaccctgtttctgggatcattctccagttgtctgcaaagattcaaaattcaaaaggcaaactccattctccactgtctgccactggaaagataccctggaggaaagtaaagcaactgtgacaatgggaatccaggatgctgtctgcagtcactttgctaggagcacaaatagaattttttacatttatcctgatacttggcttttaacccaatcctgtttagcctttttccaaacttagttgcatactttaaagtctcccctggatagtaaagactagccccatctccagtccacaaaagggaaaaagcttaaaatgactcatctgtgcattaaaaatacgcaaatggaaggggagataaatagcttggtgtgtccaatttattcccagtttcaaacatgcagctctggtataccatcccaggacaatgaaggaggtcataatgacttccatttctaggcttccgggagactgcattttctgataggccctcctctacactacagctagataagagcaaatatgcttttcaaagcatagttgagcttacaaggaagtaagggaaatctccaagggaggggttgtgggagagagcactctctggtctctcttcctcttcttataaggagcaaatgccaatctaagcactgagcttgagagagcgaactgggactcactgaagcgagggaactgagattcttctagcaagcccatatttgcagaagggttgaatgtggtcctaagtgccccctggcgcctaacagatgcaaatgcaaatccttgtaagggggacaggcagtgggtgggcaaggactgggagaggcgattaggcagagaacaaaagccctcaggagtccaaaaaattcagattaatgaaatacaagcttacaataaaaaattaccacagacacaaggaaacttccacgagtgatggccatatgcaaaatataaggtgtttttgaaatgtttaagaaaataaataaatatttcagcagaaatatagaattgaagaatcagcatggaaaagtgactctccaaaattatcaaccagatctgaaaaagaataaaaatatacagcaatgaaaaataaagtatttaaagtgaaacctaacagatggggtaagaaaaaagagaaaactagtgaacaaagacacaatggagataagccacaaacaaaatgatgcttctttgaaatgactaataaaacaagcctcttcagaaatgagtacacataggaaatatttaaaaggtgatatgaaaatactgttaactttgggccaacaaattttgaaatgtcaagaaaatggacaaacgactagtcatatcttacataatctgactctagaagaaacagaaatcctgaagagttctgcagctattaaataaatagaatcagaattttaaaactcttcctgcaaagaaagcccaggtgattccaatttgcaaaaactttcagataaatggaaagtcttcattctgtgagacttgatcatcttgacaccaaagctagtaggcatgaactatacaagaaaggtaccttctagtccaaacttcacacttagacgatgagtattattagcaagtggaatacagggatatattaaaaaggtaatacatcatgcccaagatgtgtttctcataggaattagaggatacttcagcattagacaaagtattctataaataatgttaacagagtaaagatgaaaaataattatgatcagctcaagatataaagtcttagtgttttctaaaaattgttacaaactagaaataaagaggaatttctttaacttatagagtatatctgctgcaaactgacagtatcattcttaatggtaaatgttagaagcatgccccttaaaatgagaaataaaattacgctattataagcaccacttgtagaatgttgcatcagccttctcctggaggcttaagttaggacagtaagaccagaaaataaggagaaaaaaataataattcaaaagaaggaaagttctattatcatcaattgtattatgtggttttctacttagaaaacccaaaagaatctataaattattaaaaataagaaagttatttccttatcagcagggcacaaaaaatgtagccataaaaagaagagtagtaaatttgacaatgttaaaattaggaatttctgttcaacaaaagatactataaacagaatgaaaaaacaatccacagttgagagatgatgcttgcaatacattaaaatgacaaaaaattattatcaagaatatatatagaattcctataattcaataaaaaagtaccaacagttaattgaaaaatgcacaaaagaaatgagcaggcatttcacagaacaggaaatacgatcagccaataaacatatgaaaagatgttcaatcttattagtaatcagaaaaccacatgagccatatggaagccacaacaagaaagcattttataccccactctcttatccacacacacacacacacacacacacacacacacacacacacactataataatcataatagcagcagcaaaaataaataacaatagcaagtactgacaaggatgttgatcaataagaactcctaacacagctgctgcacgtaaactagtgcaacaatgcaagaactcaccatgcatatcctcacccagaaattttacccttaggtacctgaatttgccatacctgaagccgggatggcaaactacggcctaagggccaaatctggccttttgcctgcttttgtaaataaagttttagtggaacacagccatatccattgacatatatattgtcttttttttgtttgtttgtttttttgagacaaagtctcatctgtggcacaggctggagtgtactggtgcaatctcagctcactgcatcctccacctcccgggttcaagtaagtctcatgcctcggcctcccacgtagctgggactacaggcatgcaccaccatgctggctaacttttgtatttttagtagagacggggtttctccgtgttgcccaggctgttctcgaactcctgacctcaagtgatcctcccgcctcggcctccaaaagtgatgggattacaggtgtgagccacggctcccagccttatatattgtctattgctacttttgtagtacaattgcgagtcaagcagcagacaccatatgacccatgaaatctaaaatatttactaactggcactttacagaaaaagtctgctggcccctgccctaaagaaatacttgtacatgagcacaacagacacatacaagaacattcagtacagcactattcctaatagcaaaaactagaaatagtccatcaacaggaaaacagataaattatgacataagcatgtaatgggatgttagattattgtgcaaaagaacaaatgacagctacatgcagcaggaatttatcttaaaagaatattgaacggaagaagtaaaaacagagaatatatacaacatcatctcacttagacaaggttcaagggcatgattatcataacacagaagaagaaatagaaactgagaagcactcatgtgtaacatcaacaggatgggtaattttctcaggtggggcagggaggctctccaggtgttcatgttagtattatataccataatttacatacgtgttcttttgtacctatccaacagcatagaataatctccttggatgaacctgtgggaggagtataatatagtgtgtaacagcccagactctggagccaggctgcctggttccaatcccagccctatcactttcaagctgtgtgatcttgagaaaatgtctcagcatctctgaatctcagattcctcatctgtaaaacagggatgcaagacctaccttacgtcacagagtacacacaaatcataacttcagtggcaagcatgagctcacaatatgctcagcatcactccccacgtatcagcagagcctgtgcctacagccatcctccttcaccctgcatggttgaatcagaggccagagccagggcactgtgatacacactggccctggtgcagaggtgcactgatggattatcacaggatccagacaggaaggtggcctaccaagggcagggggtgtaggatatagtctcataatcatgatgtttggctagaaaatgtctgcacatggctcctaaagtgaattcacaaagaacgagaagccaacttcaacatcagcagcacctgaaatcatcacctaccaggtcaacaagaaaaatgtatatattttttgcctttccaaagtaaagaagcaacctgaatccttgcgtcttatctcaatttatcttttccatgcagtgcacaattacagtgtagggaggaaagtatgggttttgagcaatattggctgagagtctctcaattaccagagctcagttactgaatctcccctaagccatagtttggtcatctgtaaagtggggataacagtgtagacctcacaatgttattcaaaggcttcagtgagacactgtgtgttcctctagacaagccctcaagaaaagcgagtcctcaacttcaaatactggtgacattggagccaaaatgccaagaccattaacctggtgtacttctttaaccaatcaggccactgaaacattaagcatcctcatggcttttaccagactgtgtttcaatagtgtttccccaaatacgttccctgaaacagcattctgcagatgttaatacgtgttctgttgggggagtagtggaaaggaagggttctattgtcatgtatcatataatcatgtattcactatacacacacttgcacacacacacacacacacacacacacacacacagaatgaccctctcaaggacagtttctaattttcataatgaagtatagaagaaaggtgagaggaccagagggaaactgtctcaccagaccgtcggcacaagggaacaatttcagagagaacaggtttccattcctctttgcttagctatagctagattgaggggctgggggtgcagagagtttccttaaccttggattactctgtcctgtcctctccatcaaaactcacatgcctcacatccaccactcactcatctgacaatactgctccaaagctgccaacactatgtccacttcacaagagcataaattgtggtggcttaggggatttgactgcaatcacatcattagcagatacaggccagtgtctaaaattgaggtttcctccagccaattctacagtctcccctgctctaaaaatactacagaatttcatcttgaacaactcatataagctcctatattcattcagttctgaaagaagttacaatgaaaatacaagaaactaagccctacttgagtttatataaaaaagaaggaaaaatacactttgccttagccaacgtttataagagtgacttccaatagctactggagtcagaatctaatccagatctcagaagtctaaaacacagaaaggtaactagaatgaaaatataattatatatgtatgatgtgcatggaacacacaattatttaaatagggaatagccagatgtttagaatctactgtgtcttatctccaaacatggaaaatatgagctcctggcaggtttgaaaaactgtgtgaccttaagctcttttccacactatggggaaaaaacaaaaatgataaagttttgcactgtaaagcagcttagggtttcattgctatgaaaaccgtctccaagctatataaaaatatgaattggcttatatccaaaagtcgtgaagtttttttttttaataaatccatactccttctcaagcaagtacttaccataactctttcaaagaaaacagaatctctttgcagacaacttggcctgctttacttctcctgtgactttattttcttattaatcacttcctagtttgtctgtaattaatgtgaagggcaggttctctgatccctttctctgtaatcctatgtacaggctgtacaacactcttcatgacttcaaatcttccttaggctgtgtcatgtgtgtgaaaagacaaacagcagaccagctgaaaacatgtggccccagtgtgtggtggaagagttggcctgctgagggaggtataaaaaattaatatttagacatatggtctagcctctaggctttctcttttggggtagaataccccaaggagaagcacatataactaaataaagaatatggataggtgatttttaaaagcactgggactctgggttcctcacccacacactgtcattgataactgcataactcactttggttgataatatgtgacgttttgccaagattcatagcactaagaacagtatacatgggaaagccctcttggcagttgcttttgtacacaaagaggagttctggttttcattacagaccaatactctaaggtggcacaatattggaatactgcactgagcttagagttaaggacttaagttctaattctagctttgcaactaaccagttacgtgatctggggaaaaatcactaaacttgtctcagcttccgagaacagtggtgaagagttgagttttgaatcctggatctacccatgacagcctgtgatgccttgaacaaattacttaagtactctgagcatcaggctactcatccgtaaacaggaaataataattgtaactcactacagggttcatacaaacaccacaggagatgcttactgagtgagcaaacaagttcccttaaagcctgaagcacagggcttggcacataatgaatgctccacaaatgttagctattttcattattttgagacactggtggtggctagaggcctggaattaaaatttctgtcctccctcctccgatttgggcagggaaaagaaacgggcataatgaacataaatctttgattatcaaataaatgcaacagtgggaaacaaaatgctaagcgctttggcatttttttaaataagagaaaaagggaaatagatgttttaagaccaattcgaagatggatataatttatttcacattaactgacctgtaaataactctacaagggactctcaggaataccaaccatttctgttttgaaggtcagtgttctttccctgttgttagccagtaatccacaaccaactaaaggataatggcatgccctgttatcaacacttctcaacctgatacaggttacaaaaaaaactacagtttaagaaatactggtattttaaaaatgtgttgagaagctaccccaaacgtgtaatgatagaaacgatagctaaaatagaaacgcttataatattaacagtcacagccatatacagttattataggacggctctttcatttaactgcttagcaaatgtttaatgccaatgatgttttaaaggttttattgaaatttccttccctgtcacttcctcttcaccctccaacatgttcatttagcaaaactgctaaccatctaagtacttttcagaattgtaagatgtcttacctaaattaatatcatttcaaatagctgggtggcaggcattgaactatattaactttcccctactctgagctgcctgggttcatcagccaaactctagtccttgctactttaaagttttaaagaggagagattttccccatgtaccctccctgcttctctctacttcttgagtcactccaaccctgagaagggagaataacagacctccatgctactcagaggatccttggaccaaaagcatcagcatcacctgggatcttgtcagaaaggtgggatctcaggtctcacctcagacctgctgaatcagaatctgcattttaacaagacccacaggtaatctgtagtcacatgaaggtgtgagaaatgcttccctaaacttaaaaaaaaaaagtttcagttttactactgatttaagattatttggtaatggaaagttagggaaggaaagcactctgaacacaatgctgtaggatagtcctgagaaacagactgaaaagccagtgtgtgtgattaataaagtctgagtaaactatgagtggcgcccccaatgcaggacactactagataaagtgggtcattcactcattgatttaaccattgttgaactatgtactattttttttacagatcataatagatgttgatattttcagggcacatgtgataatttaacacattcatataatttgtaaagatgaaatcagtgttcttgggatatccatcatcttctctctctctctctctctctctctatatatatatatatatatatatatatatatatatacacacatatatataatttttttttttaagacagagtctcactctgtcacccaggctggagtgcagtggcgcaatctcggctcgctgcaagctctgcctcccaggttcagccattctcctgcctcagcctcccaagtagctgggactacaggtgcccgccaccacgcccagctaatttttttgtatttttagtagagatggggtttcaccgtgttagccacggtggtctcaatctcctgacctcgtgatccgcccgcctcggccttctaaagtgatgggattacaggcttgagccacagcgcctggccaatatttttttctttatgctagaaacattcaaattattattctctagcaattttgaaatgtataatagattattgtaaactatagtcaccctactgatctatcgaaccctatgtctatttcttctatcaaaccatgtatttttacccgttaatcaactctaccaagatacctttccaagtcaaaaaggaaatcctgccaggttaaattatatacatataaatgtgtgtgtgtgtgtgtgtgtgtgtgtgtgtgtgtgtgtataaaattatatacaattggctctccatatgcacaggtcctacatctgaggtttcaactaaccacgggttaaaaatatttgagggaaaacaaaaaataatacaacaataaaaaaagaaaaaatatagcataagaactatttgcatagcatttacactgtgttaggtagtataagtaatctagagatgatttaaagtatccaggaggatgtgtataggatatatgcaatactacgccattttatgtcagggacttgagcgtccacagattttggtatctgtgggagtcctggaaccagtcccccacagataccaagaaatgagtgtgtatgttgtttactatttctaaagattccataaatactgaattttaattctgtcctgctacttattgttgtcataatttaaagaacaatccaagaagacctttaaaaattatccgatcgatgccagaagctaggaagggtgtgtgggtgaaaaggaagatgaggagaggttggtcaatgggtacaaacatgtagttagaaagtataaattcaaatgtttgaaagcagaatagagtgggtgatcatagttagcaacaatgtattgtatatttcaaagtagctagaaaaaagaatttgaaatcttcccaacatataaaaataaatactcaagatgatgaagtatttaccctaatttgatcattacacattctatgcatgtaacaaaataccacatgtatcccataaatatgttaaatgctatgtatcaatttaaaaataataaaacaattaaaaagtcatcacaatgccagttctaggcattacactaaactgttttgctcatttgtgcttttaagcagcatttctgtagcatgtctgtgctctcggtggaattttaagtgactgggaaaaccatgaggagtctgtgataaatctttttcattaattataacttgaataatgtacagaaaaaaattgaatatgtgaatatactggttcctaattagcctaataattcaaattctctaaggttttccattttattaatgaactagaatcaaaggcctgtatctttttctttctctggtgtgaagataagctacctactgctatatccacacaatgcctatggtccttaatatttagtgaatatgtatattcatatatatatatatatatatatatatatatatatatggggtgggagatgagtgaatgaataaataaatgaaagaatatgccataccccataaacaaaaatgtgtccagcataccataaaaaagtaatatgaatggacaaaaaaaaaagagaggaaaatataccacagtgatcattgctggggagaggaggatggggaaatgactgctaaaggatagggagtttttaggagaggtaattaaattagagtacttaaagttttaaattagacagtcgtgatggtttcactactctgtgaatatactaaaaatcactgaattgtaccatttaaaagggtaaattttatgatacatgaattatatctcaataaagctgttaaaaatgatgggaggcgagagcattacggatgccttcctatttcccattttcattcagcaaatattttttccaagaataacttatttactcatcatcgctaggctagttaatattctttgggttgcaagcaacagaaaacaacttggcctgtcttgagccacagaagggagtgcatgagaaggatatcaagacatctccccgaatcaaagcagcaactgtgaaaacaagacccaagaaaagaaggaagcagtacgcagcatgaatctctgtgagaagcttggttccatgttacttggtttcaaggactccctgctccaaattgaaaatacccaggatggagtatagaattagcctggcttgggccaagtgtcttccaagcatcaataggctgtggcagctgaccctcaccatcagaagctactccaagaggaagaagagttgcttaaaggtccacagcaaccccaagaagaatctactacaattgctattctgattaaagaaaaaagaagcaatataaatgatatgacagtgctatgattatgtttctttggagtaggggattcctaaagtaccctttaggactatatataagactcaggtgaactgcatgataaagatgtagccatgccagttcaaccttctgacatgcagtattcggttttctgttcctgtgttagtttgctaaggataatggaaagttttaaagatttgatttactatcccaaattaagatctctgactatgacatcagacagtctggggccaaaagcctggtcactcactagttatggggtcagataaccttgaatgggcctccaatgtggtcatacactagctttaaggtcatataaccttgcggaggtgggggctgtgggatattggcaggttattttcgctaaacctcagtttccatctcttttaaaagctgctaataacacatcttgcagaagcatgataaagttagatgataacacatgcccaatacttacttatgcctgaaacttagtaagtaccctagccaacaggaagccatcattttcaagctcctactattattaatatacaaatacagattgcaaactgttccagaatgcagtgcaaacaggtgaaactgcaattccagtgggtgggggggtggggtcagtgaaataatgtttggctgtgtctatacaaagaaaatctttcaaccagagaaactttttagtttggccacttcaagtgctaacttgaagcaaataaagcaatagcacataaaatagcacataaaaaaaaagaataaccctagattttgccacaagctggtacatgcattttaaagagacagcaaatatttaacatcactgaacactagtgatggcacagatcacaaagataatctttgtttctttttgcaggaggataaactaaggcccaaagaggttgaccactggttgtctgaagtcacaacagaaatgacagcactgctagttgtgaagtccaggcaccaaactctcagcacaaaactctttcctgctctttcccttctagctccatgtaccagtcttatttggtcactgcactgcagagggcatgttaccacataattagtttcagggtatgtgcaacagctgccacgagccagagttccacactggagtcaaatgtctttggtctagacgcatcccttccaccacatgccactgatgggacagccgccataaccacattccttactccagcggctccaagcctttaggagttggagcacatgacacattccaaccaagatgaagtaactcctctctctgaatgacttactaaagaacacctttaaggattttttcagatttgacattcttctacccgggagcttaaggactttaaaaagggtttagagaaattttttttcctaaaaatctatgtgagataaatgttaagaattaaggggccacttaggaacctggaaatgataagtcacaggagatccatgttatcattgagtaagtcaaagcaaaaaccagaaaaaaggaaatggttgttttgcagataccatcaccgaaagaatatgtcatatcactgagaaataagatctcttgataccaatcttgagtaatatctgtttgagattattttattgtatctggataattttgggcctattagcaacaacaaaaattttccttaaaacgaagactcagaaacccatgtatgcattcctaagcacatagatatatttcatatgctttaagattatttttcaaatcttcaaaccagtgaaatagaaatttctccaaaagtacagtaaaaactatatttaaacaaggaattgcaaagtgcttatttcatcccttgatgtttattttgttttacaattcatttgagacttttaaagtcagaaagagaaaaaaaaaatagctttcaaatttgagtctggaacagagctcacctatcaagtccaacagggatataaagaaagtatccctgttgggatagtttcccaacaggaaagtatagaaaaaaagaaagtatctaacagtacagatactgctggtgcccagaacaaaagcattattgaatgaaagaagaatttaaatcgaagtaagcccttactaactccaggtcttgctggcatttttcctaataagatgaactattagtcctgggttacataaacttcaacacactagatccctcaccaagtcagagggaggccacaggcctcttgaacccatgcatctgtactctatttaagatgcatgactgtccctctcttctttgtttgggtccttagctgtggactaggagaagagtgaggcacaaaaccagcagaaacaaaggcctgcaaaatgagtggaattttttgctgttatctttgaacattttatttctttatttcagaaatccaaagggaaataaaagtggaaagaattgcaggctttatggtttaaaaaagaaaaaagaaacataggatgagtttacagtttatagtatctgcgaagcaactcttcactcattcctttaaataaacttttaaatcaccttttaagtggacagaaaatgctgttattatgagttactgagatctaatgtgggagactagttaagaacctgagtcctgaattcaagcaagaaattattctaccactgttaatctctgtcctgtttaatctctggaaagttgtttgccctcagtttcttccactgtaaaatggagatgatacagttgtagtgatgaataaatttacacacacaaacagatacacacacacacacatatatacagtaaataacctctcttaatattataactagtattaagagtaaaaataactattatgctggggaaatctctttaaagattatttcacaacttattcagtgaattccaggtagtacagttacttatctccttagatagaaggcttttccttttttcaaaaagaaacatttttaaggctataacacaatctcttattatactccctatctatcagccattatgctacaaagaattcttccttcgttagagtctatacagagaggtatagtatataagctggtcattcatttctgccacaaccattcacaggtgacattcactcaactcactttcactgactgtttattcagtgtgctaagcactatgctaaggcatggggattcaacaacaaagaggcatgagacatcgtccttggccttgagaagctcttagtcaaaagaagcaacaaatgaggagacgcaatcacaacagaaaaggatgggagcaaaagggaatgtgtacaaagtgctgaggcagcacagaggagggaggcatcaatctggtttgagcacaagggaagattctgcagaggatgtgaaccttaagtgaggcctagaacaaggaagaaagatattccaggcagagtgaagggcacgggcaaaggcacatatatatatacatactttttaaatgcatggcatcttgggtggaaaaagaagacagcttgatggctaaacatgaaccccaagagtagaaggaggcagctacgaaggtagcgatactcatcaataaaggatccagaagaacatagaaagggcacttcattcagcaggggggcgacgtaaatggagtgtttagcaccacatgttgcaaactgggcttgtgaatgcattctcagaagtctgtgagttttatgaaaatttgaaagttctttaattttaatgataatctaaaaactaaaattgcctgcaaattaagacatcacttttttgtactgatcatttatatttcaatcgtccactcaaaaaatatttattgaacacccctatgtgccaggcactggggatataacaatgagcgagacacagtacctgacctcatagaagttagactaataagaggaggtaaccaagaaataaaagtatagcatagcaagagacagtaagtgctgcacagacaaataaaatattaacgtggcaagaggtagaaagtcaaatggggggtgttcatttcatacagggtagtcaagcagtcagtgcacttcttcattaacatggtatctgagcaaagacctgaaggaaataagatatttgagagatattttcagagaagaagattttacttccccacatttgtcacaaacattcctaagggtctataagaatgctctttgtctctctttctctgtttctcattgttatagctccagtgcctagtattgtgcctggcacataggagtgtttaataaatgttttttgagtggatgatttaaatataaatgatcagtacaaaaatagttgtcttaatttccagataattttatgttttagattatcattaaaatgtatgtctgtctctctccttcttttgagacaatgtcttattctgtcacccagggtgaagtgcagtggcatgatcatggctcactacagcctcaacctcctgggctcacacctcagcctcccaagtggctgggactacaggcatgtgccaccatgccgagctaatttttgtatttttttgtagagatggggtttcaccatgttgcccaaactagtctcaaactcctgggctcaagtgacccggccaccttgtcctcccaaagtgctgagattgcagacatgagccactgcaaccagcctgtttttatttttaaaaggtaatctgaaaaaatggagaaaacatttgcaaaccatgtatctgataaggggttaatatcaaaaatatatataaggaacttctacaactcaaaagcaaaaaaaaaaagacaacctgattttaaaatgggcacatagactttttttgaagaaatgtctatttcttcaaaagaaaacatacaaatagccaacatgtatatgaaacagatgctcaaaatcactagtcatcaaggcaatgcaattcaaactcacaatgagatatcatttcacgtctattaggatggctgttataaaaaaaaaaagctaaagagggtctggatgcagtggttcgtgcctatatcatgcctataatcccagcactttggaaggccaaggtgggaggtttgcttgagcctaggagtcaaggcttcagtgagttgtgattgtgccactgtactccagcctgggtgacacagtaagaccctgtctcaaaaaaaaaaaaaaaaaaaaagataacaagtcttggtaaggatacggagaaattggaacccttgtacactgttggtgagaatgcaaaatagtgtttcactaagaaaaacacaacagaagtttccaaaactaaattaaatatagaatcgccatatgatccaacaatcctactctgggtatttatccaaaagaattgaaatcaggatctcaaagacaaattcacactcctgtgttcactgcagcattattaacaatagccaaggtctggaaatgaaactaagtgttcataaatggatgaacggataaagaaaatgtggtatatacacacaacagaatattattcagccttaaaaaaaaaaaagaaaattctgccatatgccacaacaaagatgaactttgaggacattacgctaaataaaataagccagttacagaagaacaaacattacgtgattccactgatatgaggaatctaaaatagtaaaactcatagtggttgtcaagggctagggggaggaggcaacagggtgttgctatgcaactggtatagagtttcaattaagcaagatgggtaaattctagagctctgctgcacaactttacacctatagctaaccatattgtattgtacactcaaaaatttatgaagggggtagatttcatgttaaatgttcttatcacaataagaaaaaaagattccaaggcaatacctgacaaaaacaaacacaagccaggtgccgtagctcacacctggaatcccagctactcaagaggcccaggaaagaggaacactcgaggtcaggagttcaagaccagcctgggccacatagcgagaccccatctctataaaaaacaaaccaacaacagcaacaaaaatgctctacagggacagtccctcaatccagaccacacagaatcccagagatcaaacaatatttgaagagatcatgactaaaaaatttccaaaactcactaaagatacagggagcaaatgtgttacagcagggtaagcaaatgtaaactcacactcaaacatctacaagtaaaattacagaataccaaaaaagcttatctgagcaaacgacaattcattaatcaggaacctccaaaccaggagtggttcaggagttcctccaagggaatacaacggggaggcttttataggataaacacagaagtagagcaaagaaaatatttgattgattacagatacacagtatctgtactgtgttttgaagagatttcaaaaacaaccatagagaagaaacaggttaactacaaaagaacaaggactaagatgacagccgacttttcaaggaaacaaaaatattatttcaacaacatagcttgaaagggctaagaaaaaataactctcaacctagaactttactccaagttcatctgccattcaagaatgaggataaaataaagatacattcagacaaaaacagcttaccactgacataatccacctgaaattgcagcatgcttctactagcttgtaagagccaaatgtgaggtttacaggaattttgctagtctgtagaaaacatgctgataaattgaaatcagccatagtgggagtattaaaccatgggaattggcaaacactaaaaaacaggatttttttgcccctgggggaccagttcctaaatatttaccatcacgccactgacttcaaagaactagaatgtgtacatcaagaaaaaaaataaatctagaaggaaggattgatatgaaggaaagaaaaatgagaaaataaatacagtaaatgtaattctaaataagtacttatgcataaaacaataataatgatgacaattcctgaggtggggagagtgggagcatatcagtcaggtaacctccttatactgtggcaacaaacaatcccaaatctctatggcttaaaacaacaaatgtttatttctcattcatgttaaatatccttcagggtttagctagggaagtctgcccattgtagcccctcaatgactccggccaagtagaagcatcatctcaaagtcttcttcaacaattgccacaggtcgcatggtgaaccatacgctgtcttgctaagctttttcacacttcactggccaaagaaagtcagatggccacatctcatttcaaagacacaaaagcgtaatcccaccatgtccccaggagagtataaaaataaaaacatgtaagacaggaggcaggtggttggtgttaagcatgttccaagttcctcatattttcgtgtgaaaagagaagacaaatagggtaactttaaactttaagtatgcaaatttaaaggataatattaaaattttaaggataacagctgaaagaatagagaatagaattataacttccatatctgtagggaaaaagaatacagaaaatgcaatttaaaaagaggagatagacatggaaaaggcaaggtaaataagtaacaaaataaaatggtagtgttaaagagaaaactgaggcactgtaaaagtttaaagagcttatctgagcaaatgacaattcaggaatctggcacctctaaaccagaagtagttcaggagctcctccaagggaacacaagggggaggcttttataggataaacactgaagtagagcaaagaaaatatttgattggttacagatacacagttgccttatttggtctatcctgttggactgtctctgattatataagtttgttggctgcttctgatcagttgagcctacgttctgtttttctttaatataggcatttacaagaaataactcaagttaagtttttcctgtttgtaaatcaagcaagtttagatcacccataaggcctaactggttttgtttgctaagggatacttcaggcctggtccccattttaatttactttaacaatagaaataaatgcaaatataacaacagttacaacagatgtaaatgcaataaactcaccacctaacaagagataaatcatgtatttgcattttttaaatgctgctataatctgttaacaagaaatataccaaaaacttaagaacacagcaaagctgaaagcaaaaggactaattcagagcgcaggcctggaatcacacaagcatggaaatcatataattctaggtacatcctcaggtaaatcacctaaccacagagcgtggcagtttcctcatttgtaaaatgagctaacaactacacttcacaatgttagtaggattagatgagctatgtataaactgtttcagacagagcctggttcatagcagttgtttatcaaataatagctatcctattgtcattaaccctacctgcaaatccacaaacagtgggctttttgtttgcaaagaagagtgtttgcaaagaaggctgcaaatttcctcccatcctatccagataaccttttgcaatatgattttgccaccacttgcatcaagagttttagtctgtttctccaccccttgaattgggatggccctggaatggctttaattaatagaactcagaggtgaggtttatgagttccaagtctacgcctcaagagaccacgccactgccacttttgtactcttgagacttctacttccagccaagatggagttggagagatagactaaccttcttgcctgaaatgactaaaaaactggacaacatgtatgaaataatggtttcaagaacagtgattcctgagatgtagaacgaggtgagcattataactgtcccagcctactgcctggagacagtgtccaggctgcagcacaaggaggggaagcccaggcgaagaccagtggtctccctcatttaagaagaccaaattgggaatctggaaagatgatgtcaggtagagttcacaggaaggaagggtgcagagagtctctgctatgatttggatgtggtttgtccccatcaaaactcatggtgaaatttgattcccaacgtgacagtgttgggacatggggcctagtgggaagtgtttgggttggtgggggcagatccctcattaatagattaatgccatctcacaggagtgagttcccactctcgcaggactatattagttaccttgagagtaggttgttccttcttgtgtttggtctgtctgtacacactgtgcttccccttctgttttctgctgtgagttgaagcagcatgagactctcaccaggtaggctgaccaatcttggaatttccagccaccagaatcatgggtcaaataaacttctttataaatttcccagcctcaggtattctgttacacaaacactaaaaggagtaagaaagtccccctagaatattcagctattggtcatcacatgtgtgtgatgaaaatgcctgaggccaaaggaaaaaccacccaaaacgatagaggaaataatgcttggagctcacactttgctctcttggaacacagtatcatgatatgaagaaattcaagctaccgtctttgacaatgagatatcatgagggaagaggcccagacaaatgccagcaacaaccaccagacatgtgacagaggccgtcttaaacctactaggccctgtcaaatcaccagataactgcagcctcatgaaggaccttagaagatatgagcaaaactgcctaactgagcccagccaaagccagccctaagaatcatgaaaacaaataaaacaggtgttgttttaagtcaccaagtttggggctgattattacactgcaatagataactgataaacaagatgtcaaaaacaatgttatatacacacagcaataaacatccagtaaatggcccatctctaccacccatcagcttaaacgaatatctaagggcagccagcctcaactgcagcaagagtcacagccttcctcattcgcaggaggttaaaaccactgtggaaaaaacatgttttccatcatagaatcctgaaataccagggttcacatgtcacctccactgtgaagcactcgcaagattctgctgacagaaataaccatttcttaatctgtcatgagattagagtagaaaaaaaaagaaaccacttcttcctcttatttccatggaagattgaggacagccctgttctggcacctacaaccgtgtgttctgtggtcttcttatcctcagcagcagcacatcacaggcacagctaagcagttcacccttattggtagtgagtcacacagcacagttcctatccctaaacaataactacactggaagtagcatgctgggctattttaatcctgaagaaagaggtcagaaaactgaaacaagattaaaggatgactaaggaagcagctctgtgttagttgtgacagagggagctggctttaaatttatcaggatccctcccttcccatgactcacccagccttggtggggagaaataccaagtgcagtctcagggcccaacaggccacaatatacagatgctccttgacttagcacaaggttatgtcctgataaacccatcgtaagttgaaaatattaagtaaaaaatgcatctaatacacaatctactgaacatcatagcttagcatagcctatctcaaacgtgctcagaacactgacattagcctacagtcgggcaatgcatacttgcaccatcataaagtcaaaaatcaaagccaaaccatcatgagttatggacccactgtaggtaagggtctaacgggccttcatgcatcttcaaggtcaggctgcttcaaaacgggcatctgtctgctgcctttggtcacaatggaaactgacaaaccatgagttcatgctgagctgaaaggcccagatgagccacagaaacaagatgtaactgaacctgcaggaagggtaaaattaaaatcaccccagccctgactacctctgagacctcatttcctctggctctcaccttcattcacttggttccaagcactgcagcctccttgctgttcttccatcatgccaaggacactcttgcttccaggatgttgcctttgcccttccctctgcttggaatgctctttccctagttgtttcccctccctcagttttcagttctttgttcaaatgttacttctccagggcagtcttcctggaccactctatctacattaagacccccacatatgtcctgccattccctagtccattagcctgcttttttttcctcatgatctatctacctttaatttgtgtgtctatcttccaactctaacatgggctctatgagggcagggatttgactatttgtttaaaactatatacccggctgggtgcggtggctcacgtctgtaatcccagcactttgggaggccgagatgggtggattacgaggtcaggagactgagaccatcctggctaactcagtgaaaccccatctctactaaaaatacaaaaaaatttagctgggtgtggtggtgggcacctgcagtcccagctacttgggaggctgagacaggagaatggcatgaacccaggaggcagagcttgcagtgagccaagatcgtgccactgcactccagcctgggcgacagagcgagactccatctcaaaaaaataaaaaaaaaacactatatacccaatgctggtgacaatgctgcacaacacaaccaggagatagtcaataaatatttcttctattagtgaatttactagatgtcttctatacattgtaaatgtatcaccaatagtgttctacatcagtggttcatgaaaattatgaagttgtaacctctataaagacagatgctgtatggatcttgtcattatgaactatatgtaaaaataactgacatttgtaaagtacttaccctgcactgagccctatgctaggatcttttatgcatttttccaagttttcttcccaaccactttatgaagtgggtatgattaccatcccctttctacagatgagaaaactgaggctcaaagagaaaagtcacttgctcaaggtcacagcaaagatttcagtctggctccggaacccaagcttttaaccccaatgctatacttccaggtaggaaacagaatgaatgaatgactggataatgaactagagatgcccatcagacacactctggttgcatgctcttcttgcagactctgtacaaccaccgccaagctccatgtcacgtggccctactcctcactctccttcttctagcggctaaatgatcaagggatgggactctcacccctggcctggctgggccatcagatgcctcacttagaaaattagaattggaaactgagaggctgagccaggcaatggaggaggcaaaattgcaaagaactgctcaggaagagctggggccttgcaagccaaagcctgaggaaagtccaagttctgaggaagcacagtggacacacaggaagagtgcggaaagcagatagtgaagacaggagcacagagtagggaagtcatagaaatgccctaaaggagcagtgaacttggatcctgatagtgctccactttctgctccagcaaaccccagcttttttttctcaagatagtttgaacagtctcaacccacccacccaaacatattgcaataaattggtcagactagaacaaataaaaaataagagaaatggtgttcatgtccaacagaaccctctctaaagctgttctccagaaccaccttgaattacttattaatcctgtacatgcaggtgtgagagttgggatagttccagattccagatttttctttctctaccactgctgaccttatcaaggtcaccaacttctgctgcctttggccatttctggccagaagaaaagctcctgctgtcccacatgacccaatatttcagaatgaggttccctcagcagagttggtgggctgctagtgaccacagccctctcattcccagggagcagcaggctagaggctgtgccaggccatggttaggcacctgctccatcattcctctgctctctgtgaactctcctcacttgtgatgatttctcttctcaagggtcccatgccctctttctctgaaactggatttctctggggatccctggcccatcaaactagggctacgtatgtctggattccacttatattaagagctcaagtactttcccacagatgttccatgatgcctgcctgggaggccaagaagcctacaaagaggatgctgctgtcccagctccacctgctgaccagttacaacatggtcccagccaaaatatcccctttgaagaccaatgtgtattagtccattttcagactgctgtaaagaactgcccaagactgggtaatttataaaggaaagaggtttgattgactcacagtttagcatggcaggagaagcctcaggaaacttacaatcatggcagagggcaaagagaaagccaggtaccttcttcacaaggcagcaggaaggagaattaatgcagaaggaactaccaaacacttacaaaagcatcatatctcgtgagaactcactcagcatcatgagaacagcacgggggaaactgctcccatgattcaattacctccatctggtctctcccttgatacgtggggattacaattcaagattagacacaaagtggtatggacacaaagcctaaccatatcacactgaaagataatgaacccatatttaaatatcactacttagctgggcatggtagcccacacctgtagtcccagctactcaggaggctgaggcagaagaatcgcttgaaccagggaggcgtaggttgcaatgagctgagatcataccactgcactccggtctggataacagagcaagactccatctcaatcaatcaatcaatcaatatcacaccataagcacccattcatgctgccatccacacaacagagacctcccttctgaatcgagggaatcagagaaaccctaaccagcaggaccctaacacaatccttccagtttatatgatgaaactgagtcatcccaaggcaaggaggaacctcaggtccaagagagccaaacattagtaaggaagattcctttataggattcacacttcacaaactacatgtggttgagttcagaaaacaccaaatgaaggctggtttgaactgtgtgatgcaggaagctgtgaccatacaaagtgaataaggtctagccttcatcttcaaggcatttgtaactcagtggaggagagttagacccacctatttaaatgacaagaaaggcatgtgcagatgctatacctggggcagaaataaagtgctatagtaacctaagtcaggggtgaagaagagtaagtatgaccagggagggctccatgcagaagaccgaaatttggttaatcctcaaagttcctacttatgcttccagtctcagctggaatgtcccctccccaagaaggcttccaagacctcataggctgggtttgtaccctggatgtacaactccacagcaccctgaactttcttccactttcaaacctgactcatcaccttccacaattttctcactagatgcaaaatctacaaaattgggaatctcatcctcagtagtgctttgtacactacagctgttcagtaaagaaatgtgtatatatgtgtgagtactaaacaaaactgagctgaaaatgcatgtgatatcttacacccatactagaggaagataaggtacaaacgggtatttttaaaatagtctgtgcaaaggtacaaaagtgaaaaagaaatagaagagagaagtggtgaaaggggaaggtagcataataataccctcaagtaacctttaccaagccccatacatgaattctcccatttaatcctaactactttgagagggagatattattatataattattgttctacagacaaggaaactgggatagagagaggtcaagaaacacccaaggtcacacacaagaataagagccagattggacctcagcaagtccaatctcagaagctgcacacttcatcaacacctgacattgaattgaaaaacggcaagagactttgagagaagagagagaaaaaagcctaaatttggtgtttggaaaagtacaggagcatctgctctgagagctagcttcttgaaggatgcagccacagtcactggcattctgaaagtaactcaagtaaaagtagtagaacagtagagcaagggacaagtccatggatagtgaagcttagatatttctctatttatttccactatagtccacctccacccttggtcaccttctttattttccaataaaaggatacttatagatgctgaaataattaaaagcaaaatcttttgcaaattacaacatgggatgtatacttcagatgtttaaaagattttgttataaatggcctaaattataaatttgttttggaggagggttaagaaatgcctttattgttaactcccttcttctgtccaatctataggctgttgagaacagtgcacgaaaagtactattttgtttctcaatttttaaagaaataacattataaaaactccaggggagcctggagagccttcataatatcatgagttctacctccaggagccctatcaggttctcacagtgaggttcagagaaagctctcctggttcctcctgcagggaattgtgagaaagtcaccattttgaaatatgcccagagtattctgttcataaaaaggtctgccctcaaaggaaactacttcaccagagcctacctgcctggaggaagggaaacatccaactccagccccttctagctttcctgtctctcctaaaaagaaaaacaaaacaaaacaagactgagaagcacttgtgaaggtcacagcccaggggcacaggcttactacagatggagacctaatcacaggaacaactttagacacattttgattaagtactaattatagtcctctgtagttttccaagtattctcatatatatgtatttccactatatatatatatatatttccactatatgtatttccaccatatatatatttccactatatgtatttccaccatatatatatttccactatatatatttccactatatatatttcaaatattcatgtgtttccaatatacatatatatttcaaatatacatatatatttccaatacacatatatatatttcaaatatacatatatatttccaataaacatatatatatttccaatatatatttccacagctaccttaagagagagagagggtgtctctctgtcacccaggctaaagtgcaagtggcaagctctcagctcactgcagcctcaacctcccaggctcaattgattgtcacacctcagcctcgtgagtagctgggactacaggcacatgccaccacagctggctaatttttgaatttatttttacttagagacaaggtttcgctatgttgcccacactggtctcgaattcctgggctcaagtgatccacctgcctcagcctcccaaagtgctgagattataggcatgagccaccatacagggcctcatttatattaatattttctcatttcatgccaacgtgtgggaaaagcagagaagacagtggcctattttgcagataagtaactaaagatctaggaggatgctaaacattggtggagctagtttttaaacacaccaattcaaactcagtccagagcaattttcactaacccacatcttgtcctatattacctatagattagaaagagtttgctaaaataaatttactggatttcaacttaattacagtccccaacttacacaggctagggataccaaatttgaaaatccaaaatccaaaatgctccaaaatccaacactttttgagtgctgacatgactcgcaacaaaaatgcacaatggagcattttggatttcgaatttgggataatgcaaatattccaaaatccaaaaaaaattaaaatctgaaacacttctggtcccaggcatcttggataagggatactccacctttaatacaaataacatttattgagcccttactttaggcaggcactctgacaaacccttcctgtgcatgacctccttttatgctcattgcaggacttatgagggaggtactgttcggtccgttttccagcaagagattcaggatcacagaggcaaaataacttgcccaatgtctcaacatccagcaattgtgattccaaaggtgagccctaattaaccacttgatatttgtgcttcattctattcatggcaagcatcaaagacactccttggccaaactttagttaggctcctgtagaccctcttcttaaccttgatcttctgtgttcacctgtccttgccaggtctgcacagctcagtcttagcaagaatctcacaaagtcagtttagagagaatcccctacccttgatacctgctaaagttcttcatccctgccctttattgtctaagtctttgatctgcctttagcaagaatctcattggatccatttagtaagaaccccctactcttgaagtctcctcatagtaattttccacccattgacctcctcactctactcactggctatatatccccagctgtctttgctgtattcagagttgaacccaatctctctcccccattacaatacccttattgcaatagtcttgaataaaatcttcctgaccattttaacaagtgtcagaatatttttttttctttaacacagtaatgatactccagcaaattagcagttcttgggctcaggagcttctggaaccaagtttctaccacccagaaagccctgaggcttgtatgcactaggacgttcaaacacattttaattcagtatttgatctgatggaagaagtacaggagagcacaagaacactgagacctaaaaatgggaaatataactggtgggtgcgtgtggcatcggccacactgcagtaaccacctcactgccttccctacccaagtcagtgtttggtaggcatgtggctttgagagccactgaagtttggtccatgacctcctcactctcccccgtcaccaaggcttgccttttggatcccaaaagctaggcagatggataagaaaaagcctcacttctaaatttttgaggacaagtatcccacttctagcgactataccacaaaacccagattatgtaaggcctgattcctgctgaagattcactggtgaactcactcccatgtgcctccactctgagctctcagggttcagggagcagagcagggagagtggggacctaacagctgccttaaggatcctcttgatacacactctgggcctaattccaggggaaagacttcctatttttcacacacacacacacatgtgcacacacacacacacaagagatttcaaacacatacatgcacacacatatgcacgcatgcacataaatgcacagaattgcttttgctccatgaggcaaaatgcttagggaggcattaggagctactgccaaagcatccaagctcatacaatctcagagtcatctccataataatcatcatcataacaacaataatagcagctatttgttactgaacacctgctgatgccatcatttaaaccattgcatttactcctatcagttctatgagttggctagatttaccaataaggaaactaagactcagagaggtaaagtaatacgcccaacaacacccagcagagccatgatttctacccagctctttctggttccaaggccactgttctctccactccatccctgatttcacatcaggaattgtttccatcaaatatgggagtgggacacaatactcagtgtctcagagtcgaacccttcatgggccagtttcacactagagccacacagtaagtgctcaataaatatttgctgaatgagcgaatctgtttaggttcttaaattatatttccagtttactgaaggctataaccttcacttcagggtccttctaatcagatttttctgcttttgttggtgacaacaatggaaactgtgtgtccctttgatcccattacactcctaggaatcagatccaaggagataatctgagagacacttttcaatggggttatggagggaaaaagaagccagagaagaaaaggggggaaaaacaatgcatatactgcattttctatttacttggccttaaaagaaagaacagagaatttctcaacaaagaaatgaattcttaggagaaataagttaaacttttttagttcatgctgccagagctttttccaatatgcaacacgtggttacactgggatgtcacgtagtagcccctcacagtcagttaactggacactacggctaactgtcagagacggtccattaatgtcttacatttcttatgctctctctcctatacagctggtaagaatgtaaactgaaacaagctcccaagggcagggtggccatgtggatgaagaaccttaaatatgtgtcttccttttgatctcacaagtccactcctagaacccaaggaaatcatttgaaaggcagataaagatttaggtgccacaacattctttgtgtttctcatgttggcaaaatttagcaaacaacttcaatgtgctataagagaagaatggctaactttgtggactatgaagcagggaataacaataatcgtatctaacatatatttcttggtcagggaaaatgttcacaatagaacaataaatttaaaagtagaattcaaaactaaacaaatactatcaaaataatttgtctaaaaataattgttagttcatatttacctatgtctatgtaaaagatcacaaagacactccaaaatgctaagtagcaaaccaagatgctacctctggctactagaattatttttcattttcttctttatatattcttatctcttccaaatgaacattttttttttcattttcaggaaaaaggtaatttttcaatgaaagatttttaaaatctatcttcacccttcaggaaattgacttgcaatatctataatagtcaaatcatcccagagatgtgagaattttttaaaacacaacaaaacagaaaattctaaagaataactaaaggaaacatattttgaagtctaactccagccactcttgggaggctctttcttatatataacccactctctcccactgtattttatgcctattaaacttggtttgtaatcttattaatctttgaatctctatggtttaccacagtgcctgacacaaaggaaccccttaatgaatgcttgtttaatcccaaaagcaaccatctagtggactatgggatccatggtgtcatctttccctcaaatggtcttatacccttctagcaacagtctccctttcctttggagacagagaaactcttcccccaaatcccttggatgccaaggtacaagaaggtgcctggagcatctgggggccacctcctcagccaaatctgcagtaggactaaaggaggccgactggcggagggcaggagggcttcaggatggagagagatcaggcaagggctggagaagtaggccataggccaagagaatcggagaccagtgaaggcagaaagaggtttctgaacccttgagccctcagttccatccctgatgacctgattcctgcaacttagcctcatttctgtccttcccagctatggcgagaccatacatcctcattttgcttgggctgatttgatttggttgtctatatttgtaactaaaactatccttacagatgctctctttttgtctctaataactataaacatataatattaaattagaatcattaagaaatattgcatagggaaaacaaaacaaaacactgctttgtttccaacagactagggcaagaccatgcctgataaacttacttatcagaagagcagaaaacatttaaaacgttgccaaggtgattgatactgatggtgaagttgatgataaaaacttcatataaaaatttgaatgtgaggcaaagcttataggatttgaatgtaaaaatctatttatttgtttgtttgtttgtttgtttgaaacagagtctcactctgtcacccaggctggagtgcagtggcgcaatctcggctcactgcagcctctgcctcctgggttcaggtgatcctcgtgcctcagtctcccaagtagctgggactacaggcacgtgccaccatgcccagctaatttttgcatatttagtagagacagggtttcactacgctggtcaggctggtcttaaactcctgacctcaggtgatctgcccaccttggcctcccaaagtgctgggattataggtgtgagccactgcacccagcctaaaatgctatttctaatgggcatagggcatctaagcccaaaatctatgtatttcttgaagggtggcatttacactagcatgtcaggttaagatgtgacttctcaaaggctggtggatattctattcaactatatgacgtaagacactatttaacatgctcacaattaaagaagcaactgaaaactcacttcctctcagggtcctacctttcctcaagttagtacataaatggcaaatacaggacacacagatgtcagcagaatttctccatgattttaccaaaaagacgtgatgattttcaaagatacttgactaaaagaatttttttgagtcaacaaaaaagcgatgattttttaaaactggggtgaggggtgagttctgataagtagcaactccagtgtgcactgtctatacattggaacattttgcctaagcattattaatgatctataacccataagacaaaatgcaatatcgtgggcaggacaactcttgataatggagcttgtaaattttaaggtagggcctgaagaaaagtagactaagaactaaaaatacgtattaaaattccaaatcaatctagcatcagaccaaaaaagccatttaaacaataattagaaggtgagtttaagttagcagcacttgaaaaatgtatctagggacagaaaaataacactgtgtctctactctgctgtgagtcgtccttccattcactcatcggctgaatgaaaaaagtgtgaagctgtgtgccaagtgtgcgggacttggggagaaacagggtgggtgggctccagccttcaggaagcttatggtctacaaggaaaagcaaaatagtccacaagtaataataatagcagaatattaaaaaataaataagtaaataacaagaagtatctaccctaccttgtaggcagttcaacctagtgcactgaatctagagggaaagaacaccccagaccaaagaaacaccatacgcaaaagccctgaggcaaagagcagggtgtagtaaatgtacttagggaagtctaggaagtagaggcaacacagtgaacctggatttgaataccagctctgcctgacatttattagctgtgtggccccgggcaagttacttaacctctctgtgcttcatatataagataggaagcatcatttctatgcacgggattattagaatggtgtctgacacatggaaaagtgtttatcaagtgttgtggttggaacatagaaaaggagagactagcataagggcagcaggggcctaatcacacaggaccttgctgggaagacattcgagcagtctaagtctttttaaacaatgcctataggctgctatcatgacgatgaatgggggtgtggtgatgaatgcagatggaccagctggccagtaggaaatctcctgttgtggccaggtgcagtggctcatgtctgtaaccccagcactttgggaggctgaggcaggtggatcacctgaggtcaggagttcaagaccagcctggccaacatggtgaaaccccatctctactagaaatacaaaaattagctgagcatggtggcaggcgcctgtaatcccagctactcgggaggctgaggcaggagaatcgcttgaacctgggaggcggtggaagttgcagtgagccaagatcacgccactgcactctagcctgggggatagagcgagactctgtgttatgtggctgaaaaggaagaaaagctcaatgtggattgtgcagaggccttggaaaatgtttctaagacattatttctctacacatttaagagttcaactttatcactaataccaaaacttaataaaaaagctaaatactacctcaaatcaattgtaacctaactcctgttagaaaaacatatgaatattttataacctcagaattttaatagaggtttgagaggtatagttgagacatggtcttctgatgcttcaaaaaaaccacctctgggtggacaaatacttgaggcaaactctcagtaccagtatcagctaagtctgggccctagtgatgtacttaccaaaggaaacttaataaacgcttcaagctcccagatatcccatttttcctatgtttcttccttctggaaaaccggatcttctttaaaggaatgactgccaacaggctgaacccacaagtataagcagaaaggcaaataacaggtccactgtgccaaaccacagtttcccacactgattaccaggtaaaaccctgaactttcagtatagaggttaagaactcaggttttggagtcaaagagattggacccaggcttaggacctggctccatcacatatggggtatgtaaccgtaagtactcaacctcaacctaatcctcagggtcctcatttgcaaaatgaggggaacaatttcacctggctctaagggttgctgtgatgatgacctgatagaatatgcataaagcacttagctagtaagcactaaataaatgacagttatgattattatccatctgtggttcccacaatgccaccaaaattggggattagatgaggtacagaaaaaaaaacactgctggcaaattggccaccttttttggaaaattttgtggcatattgacttaatagtgaagatacacctacccactgccccagtacttccactccaagatgtgtactcagcaggcgtgcaagccacatgcaccaagagacaagagctggaaagctcacaggagcatcattcagaatagccaaaaactggagacaacccaaatatccatcaacagtagaatggaaaaataaatgatgaaatgatggtatatttatatgatagaataccaaccacatggtgcaaaaaattaatagatcatggctacattcaacaaaagggacaaatctcacaaatccaatgctaaatgaaggaagccagacacaaatgaatatgactagatggttacatttgtataaagttgaaaaacaagcaaattaactctagcatttaagaatgcatacttaggtggtaaaagaataaagaaaaacaaggaagattaccatgaagtcagagtaacagttagctttgaggggaggtagggggttgtgacaggaaaggagaacacagaagacttttaggttgtttccttacttcgtgatggttacatgtgtattgtattgattcattatgctgtacatttatgttttgtatacttcctatatctgtgtgatatctcacaataacaaagcaactcttaaatcactcctgcctgcctcatctaatccaggccctcttttcaggaacgtcagagaactgtggtctatgcagttagctctgcctttctgtaccgcctgtctacttgagccaaaatcctggtgggggatgagagacaggaaggatacagaagaggtgagaagatgggcctgccacctgcaattgccttcatagaactgtctaacctttccatcccagtctcaagggatactcccagggtcagcccctgtcttttatcatgtcacttttgagacatgaaaacaaagaagagtgagtgaagacgcctataattagcacaagcaagaaatgaaggacacaaggagaaatgccacattaaccactcattcaacatatacaaagtgccaggatacagtgactgttctgaggggggaatatgacccaatcagggccaaagtccttccttaaaatccacactgggacatttagggagagaagcactttctccctaaggctgtcaggccacaaaaatgagtctggacttcaggaggccacttttaccagccatgtggaggaagcatgtctgcaaatgaacaaaataaagctgacagaagagggcaaaagggctgagagttggacagagataagacaagtgcctgagaatggtgccttgcatcaagagtagcaaaggccagcaaaggtagggagagggtttcaatagcctcgagtccccagttccacctctgatgtcttgatttctacaacttagcctcagttctgtccctcccagctatgggagacaacatgggtcatatctcgtgctcaattctaataagagaaaagttaataacatgcaagtctttctcttaagggagccgcaattgaatcaggaaaatagaagtaacaacagatcatcacacagcatatgggagtgcgccatcatacagaagtggcgcaccttaaccagactagaggatgagagggaagtgttagggaagagtttctgaggaggtgaactatggaatgctttggtttcatcaggggaaagagaagtgtaagggtagtcaaggcaacaggggcagcttgtgttaaggtggggaggtatgaagggaactgggaggaaggacactcagaatactttggcactgctgaagtgcggtgtggctggcaggagaagccagggagactggtcataaaggagctgagaggcacttaaaggcctctgacttcacataggcaaagggagcctttgaaaagctttaatcaagagaaagatttaatcaggggtccaatttcccttttaaaaagatcaaggagatgtttcctaagtccaatgtctggcaacaggaagacatgtctctctctctccctctccctcttcccacccctgtccttactccaccctctctccagcaccctgaatctctgaaactcccttctgccccgcaactttcatttcctgaatttcccaccctatggtataaacaatagggacaacaccagctaatgacaagagcaacagaccagtggtcttgaaagctggatctaatcctgctctcccactaccaggccttggacccaggccaagccaccacagcctccgggctcatctgcacggacaaaacgaggataacaagattagtctacatacctcagaggtgctatgagaagtgtgtgaaagtgagtcaaaatcacaaccccaagatattgataaaagtgacatcctgatgcaaatagcatcacaaagcatactttatttgttctcttattaattataagtaattaaatcctatgatttggtaaatatatacacagtatccatgttttgtttaaaataagttaacatggatttctcatatctgaacatgcccaatattattttgggagtaatctgttttgactttattatattatctctgataaggacagcattaaatactatcattaaaatgatatatcctgatagatacctagtatttagcttaaaattaaataaagataacaatgttaaaatgtgtttaaaacacaggcttaaaaaatgaatgcagacacccagacaagtttcccaccagtgataaagcacttgtacctcagcagggtatcaaaatcccttaagataaaggcaggtgtttcctgaaattaggtagcaatattgcttctaagatgaagctgtgcaaacctagtgggagagaatcattgagggtgtgtgtgtgtttgtgtgtgagagagagagagagagtgaatgtgtgtgtgtgtgtgtgtgtgtgtgtgtgtgtgtgtttaatctcactaatttacagagcatatttttaagcattattagcagccttggggcaagttttcttttaacagcatgcataatcgtctgacaattgcccacaaggtggcaccaaactcgtgccctgaggacaaccaaggaaactttttaatagtaaaacagatgctccaaatactcaacagacatcttcctttatagcttatcctcaacaatgagccagatttatagttataagtatctccttctctctatatggtgcaaaaattaaaacctattgctgcctacaagaaaacagtaaaaggagaaagacctcctcccaagatagacctgtgctacttctgagcagttttcaaaagaaaaaaaaagtatctaagtcctaaaaataaatgttccacttctttgggggggaaaaaatcctgaaactaatttagctcactgaatggtacccagaagttgatccttcttcctctgttttaaattttatcttattgagcttagatgagtcggtgtaaatctttaaagaactgactgttatttaaaaattaaaacagatttgcaattaatacttaatgtgacaggtcatggttattttaaagggatgagatctattattggagactgtctccttcctgccccctccaccttcctccatcttacaaaggctattctaaggtgaactggttggggctggagtagagctctggaaacctataataaaagtcattctgggaacagacacaatgtatcactgttggcttaggagatattctgccaattaaaaacagggcactgggacctgagcccctgggagccaagccttccattttgaagaagcagaagttatgcagagcaatagagaatcctcaaagggtccagcttcctgttagcatgagagacagaactacctgttgggatgaaaggtttatttgtccccatttgcaacacccaccacagataagaatgaccctctgtgaatggcttgagtcatgagcttgccaatcttttaggggcaaaaaaaaaaaactaaaagaaaagaaccagatatatcagtccattctgagacccccaagctctctatcaccagatatcatcccactgtgcccagaagccccagtaatcctgttagcaattcctgagtcattcattcagcctccagaacattgctttcccaaggaaagacccctcattgcaactacttggcttctaattattggtgatccctgaaaacacagggtaaaccttttatttctgtttcctaagcagggcatcacctacctctggaccacatgcaggattcgagatctcagggaagggcatcctgggaggcttatgaaggtattttctgtagcccatgctgcccaccaagccagacactcctgcaggctggctggagaggcagggtgccaaagggaagcaagcatgtggtcctattaccaatgatcttagaacctgctcatttatcactctgcattctgcaaacctgcagtggcaaccctcccaccctgcctctcccttcatgtgaggaacatagaatccagcttttcaggcaactctctttccagcagtctgaggctgggagtaacccagcagaaattttagctcaaatgtcccagaccattttataaatgctgcacaagccccttcttactctggtttcaaaccaagaatactacttattgccatcacagaactcagaataaattcatacaatgaaatactgtgatcacaaaaacacgtaacacttcattcactaagttatgccagtaaattcactaagtaatttcagtgttagattccataataacaaatatccctagtgatacagcttttgatttaaataggtaggaaattaccattcatcagacatttgccatatgccagctattcggctaagcacttcaatttccatttgaaaattgaccataaccacagacttctgaagaacccatgtcaaatccttgagtgtgctcctatatagcattcaacacacatttttatcaccagagtgtaccaggatggacacagaaatgaaacagtctagccctgctctcagaggactaacacttcagtagggaaggagaactgtcacatgattctgccaggtgtgtgtcaggcactgccgaggagagagtgattactcattcatatattctagacctcaccctttttggaacaatttttaattgaagaaagaggaatacaatggaatataaaaccgaatagagtggagtagagagaagtcattaagaatctgagaaatgatggtctgtgggatgagaaaatgatccctcctacaaggcttgtcttttagctcatggaagataaatgagttctccaggaaaggggcatttattctgatgaagttcaagcccctcagcctgtctctgcctgatcttctctctcaccccattcaagccagggctaatcacatcccttccttttgatcttcatcacatctaaagacttgacagacccataccaacctttcccaccatcaggttgaatattccttctctctcaaccaggttcatttggatttgtccttaaagaaccacctcctttgggcagccttttaggatctctctctctttctctctctctctctctctctctctcacacacacacacacacaaacacacacaggcaatacacacatacacaaacacacacacacacaccaggctgtgtaagaagctccacacccaacatttccccattagaatgaaactccacaagtcctgcttaccattgtgtccccaatgcctacaccaaaataagcacttaatcgataattatcaaattttaggctaggcacaatgggttatgcctgtaatctctatgctttcggaggcaaaagtaggaggattgcttcaaaattaaaaaaaaaaaattagccaggtgtggtgccatagatctgtaattccagctactcagaaggctgaagcaggaggatctcttgagcccaagagtttaaggctgcagtgagctatgatcaccttactgcattccagcctcggcaaaaagtgagacttcatctctaaaataaataattatccaattatcaaattttaatttttagttaatatgacttgctcccctaaaagactgtaagctcatagaggaccaaacgtgtctggcttctagtaagtgcaccagaatgttcactgaacaaacagcaaaggacaggacacaaagcagacttgtctaaattaaattaccattccttattgtaaagttcagttttttaaatcataaatttcctttcttcacaaagtcttgcccttgttaccttcacaaattctgttgttttcagaagccacaatataacgctagactaaagaattcaataacaacaaagaaaggattacttatttgaataatcctttctgttgaaatttaacattcttttcccccagagaatatactgcacgacccctggctcctcacccacctatgcctatgttactaggatttatcagagtaaacaggcagagagaggcagacggatgtttcaaatgccatattaaacaaaatatctttttacatttgtaaaataaataggatttcatttgctcacatctcctggaaaaagtggcaagaaggaaagcaaagaaaacaaacgtgagaaaagggccaaggcaggcctggcagaatgtataataacctaggttaagctggctacttgagccctttagccctggagcacaaccagccctccattgccctggcaaacaccttccctcctcctcctcctcattctccaccgtccccaattagcacactgagagaacctaacagcgacatgtcttcagatggtctgttgagcacaaagctcacaattactgtaacgaagtgccctcaggtctgtctttaatcagtgtctgcaccattgctcagggtgaagagccaggagccaggagttcctcacccgccacaccaaaaccccgaggagtgacaaggaaaaaacatcatcctctaagaaagggtggacctgacacccatatactatgcatttaccaggtaaatttatttatttctttgatagcttcttttccgttagcaagccacccccaacattccatcaaccccaatcaaataaggaatcagaattggagcatttccactaatggaacatcagttgatggcctcatgctctggtaatggtggatcattcaccgaacaatgactgagtgcctactatatgccacagatcacaatagtttatcttctattcaccattaggtgtctcaggacaaggctatgttttccaattctaagcacagcatctgctacaggaaaaaacgggagatatacaacacatcctcgttggatgtgtcaatgaaaaccaatgtaccagttcctaatctacatgttcttcctcagcaagaccacttacagcaccaagcttggggaatacccaaggctggctaacttataaagaaaagaggtatttatggcactgaaatcagaactaaagaaaaactaatatttacactagaaaagaagtccccaagtctcttctggtaaatgaatgggcatggctatattccaataaaactttatttacagaaataggcagcaggcccatagctgacccagaccagacactgtaaggatctggtttaccctccctgaaaacaacaaagtctgaatataggcttgcctttaatgtgttttgttcaatcattcgttcaacagcttttattgaccatctactctccgccaggccctggagacacaacactaaaaaagacaggcatagccctactctgatggggcttacagtctggttgaaagggcaagcattgggccaaacactacccagagaagttgcaggggatatgaaagtaaaactcaggtgcttatagttcactctgtctgttcctgggacaactgaggaaaatggttagtttatgaagaccaccatttgtatggtgaaagagaaaacgtcactggggggactgcagaggtgaggctagattgcctacttcaaaaataatgaaacatttatacaaagaggaagactacagagctggggagtgaaagacaacaatgataccagtaaagaaaagtgcgcagaaactagtggcagggctcagctgtaaggttctgtagtgatcacatatgagggtggtagaaagggcatcagagcagtattgaggtttccgctgtcttggataacctaatccccacatgcatgcccacacttaggaatattgtgggatggttgagcaaacacatgcatgcaatctgtaagcatatgtcatggagtgtgcagggtttatcaggcatgaggccctgagaagactgtgttacttcataccccacctgttggctgtgccagaccaaggggagaagaaagtaatctagcacaactttcaaagtctcactgtatttacatttcagagatctaccccttaactaacctggggaagccaaaaccacccaaagggacatcatcccaggagatgaatccctgggtcataggatatgaatatttttgaggcttttgatacacttcatccattccattttggcttcttatgttacaggaatctctatggaaaggaattcagtgtaacactttgaataaaaaggacacgctatatatatattaaaagagctgccctttatgaatttgctaacacatttttagagactaaaatgactaaaatatggtctccatggctgtgtcacatttttttaaatttctacttgccaactggaacattttaaaaactgatgttggccaacttaatgtgattattaaaataatatttatcatatcacaccatatataaaaatcaactcaaaatggattaaaaacttaaacataagaccttgtattagtccatttttatgttgctatgaaggaatacccaaggctgggtaatttacaaagaaaaaaagtttatgtggctctgaaatcagaactaaaaagaaactaaaatttacactagagaaggggtctgcaaatcttttctggtgaatgaataggcatggatgtattctaataaaactttatttacataaatatgcatcaagccaaacctgaccaatgggctatacagtttgtcaactcttgcagcaaaggcaaaaatcagttcataacaatactgtcttagtctatttgctgttgttataacagaacaccacagaatgggtaatttataaagagaagaaatttatttctcaccgttctggagactgggacgtccaatatgtagaggccagtatctagaaagggcattcttgctgcatcctccaatggagaaagggcaaggagagagcaggggagagcacgagatggagttcacagccacaaacccttttataatcggcattaatccattcataagggaggagcctgcatgacctaaacatcttccattaggccctacctctcaacactgttgcactggggattaagtttccaaaacatgaattttggaggggcacattcaaaccacagcaaatactaacttgcagtgtattacaaagaaatcagcaatttaatcccaaactgggaattggtgttagacaagatgaaaacctggagaccacaagaaccaaactctgctaaattatgtttgcaaaactggaaccacgtatgtttgtgtagtgcttgtaaagccctccacagttgagactcaaaataccatggtagtcgaaacaacactgagctggtaattaagctactgtctcccagctccaaacccactttttcatgccatctttgtgatgctagggctggtgctctgtgaaccacatctctgctttgtcagctgcttcctgttaggttctgcctatagggggcgctggaggaaagctgggaggctggaggaggaaggcttggcccgttcctccctgtctgattcctattggcttcctgcccctgtgagcgtgacccagccacgcttcctcactctagcaaccccacttcctttctgtggcagctgctgaatccagtttgcagttctttctggaaccagcctcattgtgttgccttaaagacccccaatcccagcctgcctcttaccagacttcagagattccaacaccacctggacagtaccaactctcagaggtctgggtaccaggccctcaactaccctcctcttgagctcagaggccctagcactagctatcaccttggagatataagttcagccccacttggcccttcctacaagcttctaaattttaataatcctaaccccaggaatggcaaatgcctcctgcagttgctactttccatgattccttagtgttgtcttactgccttctcagttctctaatatctggttaataattttaaatattaaatgctctctgttgaagtaattggtgtagcttctgtctctaactcagccctgactgatacatagtccagcaatttcaaaaataagccaaatccgtgtttgtatttcttgaacactatggagtggacacataattctcaattttgcttaaaatcccatctgttgttctcaaatactacagctgttcccaggccagacacctaaaaagctccatccccctaaattccttctacccttagcttctccttcccttctgtcttgcttccctcttcctttccttctaattctccatcacaaaagcccaagaaccaatctgccaaaaaggctgtgcatcaggagagctttgggtccttttttcaggccagagattatggactgaaatgtccaccaggaaaaaaactctgggccaggcacaagaattctggaattccaacaccatcatatcttgattgcatactgcaactacattcagcctcaaagtcagagagaaatgttgggtggtggggccagtggggactacagagtgtgcgtgctgtctagatgctagatcttcaatttttcaagggaggcaaatatatatatttttatttataaatatatataaattaattttatatatactacaatatttaatatttaataattatgtatttataaattaaatatatacaactttatgtcaagatttctatgtgaaatctgcaggttcttaaacattggttatattttattgaacactctgtgcaggttaaatgaaacttgcctcatcctgcctgcatgccctctttgctaccactctctataccagccccaaatggacccaatatagtccattttcttgacaaagatttgacgattgaaactatttattagtagccacctacagagctccaataaataatagcaaacccaaggtaaacaggattctttaccctaccacttttctaagataccaccaaaatgaaagaaaggaaggaaggaaggaaggaaggaaggaaggaaggaaagaaggaaggaaggaaggaaggaaggaaggaaggaaggaaggaaggaaggaaagaaagaaagaaggaaagaaagaaggaaagaaagaaagaaagaatttagtaacagaagatgctacctgatttaaaccctcaaaaaatctgtgattcaacttaaaaaaattaacagaagaaaatagctctctaaagcaaagcttttagagtttattttagaagaaggtggtagtgctacattattttttaagtaatatttacagaacagtttgttctggagttctaaatgacacaaatagagcaggcctggtgtacacacaccaaaatggtgacaacgaaattagggcttgatccggtgataaattaccctctgctcatctcacgaacacctaaggctccaaaatggagaaggcatcatttgaataagtgaaccattggctacaaataagggcacacacccacttacccccaccaaccctccacatacaattacccaatctctaagagaaagacacgctggctctataattaccagatgtgaactaagaaactatgcccttttaaaagcttagctatatttcccaatcacactttactcagcctcagagcaaactccaaagcagtatgatgcctgctcctgaaaagtctaaagggaacaatagacagcagggcctacttgagggttgagggtgggaggaggatgaggatcgaaaaactacctatcaggggccaggcgcgtggctcacgcctgtaatcccagcattttgggaggccgagacaggcagatcacaaggtcagcagttcgagaccaacctggccaacatggtgaaaccccatctctactaaaaatacaaaaacacaaaaattagccaggcttggtggcaggcacctgtaatcccagctactcaggaagctgaggcaggagaatcgcttgaacccaggaggtggaggttgcagtgagcagagaccacgccattgcactccagcctgggcgagacagcaagactccgtctcaaaaaaaaaaaaagaaaaaaagaaaaactacctatcaggtactatgcttattacctggatgatgaaataatatgtacacccctgtgacatgcaatatgcctatagaacaaacaggcacatatacccctgaaactaaaataaaacttaaaaagaagaaatgtctagcccagaacaacgtccaaatctacctgctgggggacaaagcaatatcactgatgctagaatttgggggacaggaggtggatataatttcatattccttatcccaacatgtcactgtgtgttattagtgcagaaggaaaaaaataaaatttttcacagccaactgttttgtttagcttcaacaggggcttattgtcaactacaatagaagctggcctatctaaaatctgcaacctcactttccaagagccaaaaaggaatttgtaaatggcctctgcagagttcacacggttggcatatgagccttattcatatagtaggccatgcctaaagactccatggagacctattgtatcttcagtctgttgactcttacttgacacaaaattctaaccaacctggttgattttaaagtttacagctcaaactcaggaaattccagtatgaagacaaatcaaaggcacttggaaaagaagaggatatatatatatatatacagtgaaatgctcatggtagagacaccaaatgctgaagagagagatgcattaaagaaatgaagaagagtccatgagcccattgctcaaagaaggccttcaagggacagtgcaacttgtcaaaagccagaacagactggagccaagtaaaaaaggagagcatggaaacaggcagtacactaggatcaatagaaaaggaaccaactggaacaatccagagtggcaaaaaggccatgattctcatgctgttggagtggcagctgatgtttatcatggacttacacattcagtcttggtgcaaagtgctttatctgctttctcttattcaatactctcagcaaccctatgaagcaggctttatgtaaattttacaggtgagactacaaaagcttagagagttcaagcccaaggtcaccttgctaggaagagggatagccagaattgaacttcaggtccgcctagttccaaagcctgccctggggtggaggagagggagaggcagacagaggaaagaaaaaggatgatactattaatggtatttaataatattttgttacagcagcctaggtaaactaacaaccccatttaacagatgaagaaacagagcaattctttaaaacattcattctaaaaaagaagaaaaaaaactttcccagtggaagataaaactaggggtatttgacaggcaaaatgactccccttgtaacagaacactgcgaaggaaaattaagcagaactactagatgacataaaataactgaccatttgtacgcatcctttttctttcttttcatatttgaaataacataacttgcagtaagatcagcaaagggaaaatctctgtaacaaaatttcatttatagaccatacccatgaaaagtttaagcttgacactgatacagggcagggcatcatcacctgaaagaaagggaaagagagacagaaagaaaaaaagaaaaagaaagaaagaaaactaacaacccagaaaactaagcagctcattacatgttctcttccaaattctgtagaaccacacttgaagtgacagatgtgaagaggaaggaggttcacactcagaaaggcaggagaactattttggggaggtttgttggaggaggtggcagagtgcctagagaactagtgcacagatgtagctctggcatgtgtatccatccattcattcattcatgcatacatgcatgcatgcagccaacatttactgagaccctactatgactcatcaacagaagatggagatactgtagggaaccagacatagtctctgcccttaagaaactcacaatctgctgggcaattacagacacgtaataagtcaatgaatagtcctcataatggggactttaggaactaagcatgagatacagggagtagaggaaggcttcttggatgtgacatgtgagtcttgaagtggagaataaccaaggaaagaagtggaaggaaggctggagagattaccagggacagggttttgcatgccacaatgagatctttacattttatcctgaaaggaatggaaagccattcaagattcattatccggataattacatgtccagattaacattaaaaaataaaaatctagagacaatgtagataacagcgtggaaagatatttagactggaggcaggtcaagagactactgtattatctaggctagaaatattaaaacctaaactaaggtggggatgggggaaagtgaaaaagaggaaaccaagttaagagacacttaggagacagcatcagtaggcatttggcactgatttgtacaggggttacaaagaagacaaaagaagaatggcctcaaagtgtgtgatttgattgtggtacagctaggatgctggagacattccctaagaacagaggacacaggacaagattgcggggaggtggcaagctcagacttgaacatgttgaatttaaagtgtctttgtctggaggtcctagtcattggtgtctctgtgttgcacccactgtattagttatatattgctacataaggatattaccacaaatctagcagttaaaacaacacacaaatatttatttcagtttctgtggatcaggagtctaaatatgacttagccagttcctctgcaagggtgtaatcaaggtgtcaggcagggttgggttttcgtctgaagttcaactggggaaggctccatttcctaggtcacatggttgttggcaccattcagtactttgcagactgccagactgagggccctagtttcttgcttgcttttgattggagattaccctaccctctttgccacatagccctctccataggcagctaacaatgtggcagctttcttcttcaaatctggcaaaaaaaagaaactccttccaagccagacattacaatcttacgtaacatgatcatgtgcatactatcacatttgccatattctactggttagaagcaagtcacagagcctgcctcagggcagaggatcacaaaaaggcatgagtctaggaggcaagggtcatggggtctgttagagtctgttagaagggtccttagagcctgtttcaccacatccattttcatttagtctccaaaagttagaaacccttagacctgctttcttacctcctatggtcccatggcctaagcaactagatactgaattgtatgcaaatatagatctacaacccatccatccctctcagttcaatctctttcatgaagctgtcccaaggaggctctcctctctctctctccattctgatctcatagcacttaaaatctaaagtaatggcttcgagaatttgagtgtcagaaaactaaatatcccccaaaaggaaccaacccaaatgtccatcagtgatacactggattaagaaaatgtggcacatatacaccatggaatactatgcagccataaaaaatgatgagttcatgtcctttatagggacatggatgaagctggaaaccatcattctaagcaaactatcgcaaggacaaaaaaccaaacaccacatgttctcactcataggtgggaattgaacaatgagaacacttggacacagggaggggaacatcacacaccagggcctgttgtggggtggggggaggggggagggatagcattaggaggtatacctaatgtaaatgatgagttaatgggtgcagcacgccaacatggcacatgtatacatatgtaacaaaccctcacgttgtgcacatgtaccctagaacttaacgtataataaaatatatatatatatataaagaaataataatagctgtcatgtattaaatgcttactatattttactcactatactggaaaccaaatatgcaatatctcatttaatccttataatgataataaattaagggtacatattattccaattttaccaatgggaaaactgaggcatagagaggctaagacactcacccaaagtcagatagctaataagtggcaggaatcaggcagcctgactccagagcccacactcaaagctagcccaggcacttagatatcaccagttacatttttacgatcttctgaatgagaaaatacaaaatagctaaaagctactttgaatccagtaacagttttaaatacaattttccaacacactagtatctacaaacatttgcaaaaagctgtatgtacatgtgcaagcatttattctctccacagacaatggggattggcgaccattcgcagagcctcacagcccttcctacatggctcttcgctgggcaccagttgccactgccacattcttttggtacctggattgtaatgtacatcagcaattctcaaacaggggcaattttgctcccaggagacatctggcactgtctggatacattttttattgtcatggttagggagggggtgctaatggcatctagtaggtagaggccagggatgccgctagacctcttacaatgcacagggcagtcccccataacaagggattatccagcccaaagtatcaatggtactgatcttgagaaatcctaatatgtatcactgtaaaatgctctacttctctcatacatatttgtcctaactctccaagataaacctctatgccatcagagcaggaactacatgatacccatgtcactccacctttcccagcctatgcctaagttcccaaacacgggaagtgtccaagagatactttttgaattgaaatttatttcaaagaaattctaggctttacttctacaagacctagttattcaatgattaacacattccctccaaattaagaacttctagtttgaatttactgaaggctaatttacttctggagttaacacagccctccccagcagcctccggcacctgtatgtttgaattagcaaataaatctctggtttagaaaaatcagataaatgaaacaatatgcagaattgagacaaatagggagatacagaaacatcatcaaatgccaaggactggaaggtgcctatttcctaatgcaaccactctccccttaaacaaaggcaagggcatgcaaatgaactagggtccaaaaatgatccttttcttttttaatcacaaatcattgtgagtgaagagaacattgttctgaagcacatcagatatatttgctgaatgatgaatgagcccctgttgtttgttagcacaagtgggagttatgtgtatattaagatgagaacacactataattctaagaaggaaaaggagctattatttcacctttttttttcttgttttctttttctttttcttttttctttcttttttttttttaacacattctcactctgtcacccaggctggagtgcagtgacgtgatcacagctcactgcaacctcgacctcccaggcccaagtgatcttcccacctcagcctcctgagtagctgagaccacaggcatgcacatcatgctcggataattttttttgtaaagacaggatcttcccatgttgcccacactggtcttgaatttctgcactcaagcgatcctcctgtctcagcctcccacagtgctgggattacagcgtgcgccacgacacccagcctatttcacttttcaacatacagaaatttaaactcatattccagacgatgagtcagatgactcctccatccaatgaattttgtacaatgtaggcaaatattgcattgtgtatttccacacctctatgactcaatcttagggtaaagtctggttcctctttccctctcagataaacaaaaaacaagtccattgaatcccagaataacttgaaacctttgggacctgcctacactgctgagaaggctctgaaattgttctgtctgctccagcaccgtactttccatggagaggtgatgaatcagactggacaggaccacagggtctctgaaattcctcaggagaatcttgattacacccaattagtgagaccatatacagaagcccggtgaatcagacggcctcacaacccagcaggtcagcagggctagaaaaccaaggccattagctcctgctgtgtcctacctctcaaagaatcaaatccaagctggttgtgaaaaacaatggccattttatacaatcagtcccagattatttttaagggggatgtgagagattcaaagcagtggagaacaccaaagtcactaatagtcacatttagaatccaccagaggttgttttttgaaatgaaaaatctgacttctcaaatacaattttcctaggctgatttaaacatttctcccaagctctctgggccaaatagcatcagaaaacagtaatacaggtatgtacgagggcctggggtaaagtggcctgggctgaagttcatctgagcattggcctggttctataaggttggtaagctcatgtaggtggacggagcccctggctaaggcctggttcaaagtttgagttggcatgtagttggcatctgactataccctgtcgttcattcattcacatccgactcctgagctcagacctcaatacctcccaggagttagccctctcttgattcattccacctacactggtcaagcatctactctcacatgtaaggcctttattctggcctttccttcctttcctggtgcctacatacccagattttacgcattctccacaattctgtggtccaaatccaagtgaacctcctctaagaagctaaccctgaccaactccagctaacacagtctcacaatattctctggataccagacatcagagcagctgtttgttgagctcagatgatactccaggtaccatgcccaacatttcacataactgatctggtttaattttcctatgctgggtaaatatcactacccccactttattgatgagcaaactgagactctaaggaaaagcatcttgcccagatttcacagctaataaataatggagctggaacacaaacccacaactgtctgacagtagagtttaggcatgaaatcaggggtcagccaactcttctgtaaacaagcagatagtaaatattttttgcaggcctcacattctctactgcaacctctcaactctgcctgtcattgtagtgcaaaagcagccatgcttctatatttcaaaatgaaaaatctatgtttctgtatgaaacatcctcctgcatagagtcaaagggctctaagccccttagcagttctcctctcaccccagtgcacacagctctggacttacccacagtaacagcaacctttactgggggcctgttagaagccagactcttcccaaagacctcacaacaatccttacacaaggcagaggccattaatttctattctcacgtgagccaatgagctttgagaagtgaaggaacttcacaagcttgccccagcagtgaggtgtggcctggaacttgatcccaggcagtctgacttaacaaccacaacttccacctctacagcctgcataggcccaggctgactacagctggagctggcacctcttcagcttgagctcccagcacagggtcctggtctcctggatgctctgctgcccatgtgtgtccacaggagaaagttacagggttgctgcagcctctggcttctgacgtgggtctcacagactggcagtcagacctacagagtgtaccgctaatggctttaaacaagcagaaatcatattcagctaactaaagatcaagggccattgcaaaacgcctgatttcatattccattgttaaactttaatgagccattacatccactggaatgaatgatctagtatgtcatatcccataacataatttttaaaagtctaaataaatactgcaagcctcaaggaaatcacttcacagagcctcttccatttatggcccccactccaggtgtgcctgaatctattctgaggcaccaacctgccacatcaaacgacatcatccttataatgtttccttttccaccagactccttctgccctaattgtgcaaataatggataaagacaagccccataccggctaagcagagaaagggggaatgggtcctgataacaaagtaatcaatccttgctctccctgtgggttgatatgttttccagtggcgcatacatgagtttcagagtcagaaaatgagtttattgttggaatgaacttgaaccttagtaatcctcaggttcctcatctagaacatgagaacagaaatgactatggcataggtttctgattacaccgaacaatatttctaaagtgactgacccaagcactagtccccatcctcctctctttcctcttatatattttatttttaaaccacatgaaatggaataattatcatagtgtctgttgttttactttccatacatattcttttaaacttccaaatagttcctagcatgaagtagaagaggcactatgacataattatgttggaaatgcctacagaggtggtcttctgagttttttttaggtctgcaattaagtgtatgaaatagttaataggtcaaaagcctacttcaatctagcttacatagtcagtgtggtacgtaatgcaactatcacctaactgaccacacatagcttggtttctaaaaggcaataacatccaaaaatgtgcaacagatacacactcaggctggtggcttaggccagggggcctaaagccagattcctcagttcaaatctcaactctgccacttagtaactgtggatgtgggcaaatctgtagtctctccaagccttggtatcctcatctgcaatatgggataatggtgcttgcctcatgagcttgttgtgaggatgaagtgagataatccatgtaagacgtttaatatactacttgactccttgtaaggattcaatacctgtaggttattattcttagtgtcactattaatgctgacttgtcatcactgaggtgatcctaaagaatatgcaattctggaagaagagctgaaagagaatgaaaagcaataaaattgcagagcaataaaatcactgggtagggtagatggcctaaggtgacacttaaggggctaactcagttgacagaaatgtattttaacatgtgtgtacgtgtgcatgaatttgcaaaagtgtacacatgtgcaaaatctggcatatctgctaaaagccccatcacaatatcatcatgcctcatgtatctaaccagagtggggagtctatcacagaacaactgtcaagttaaaactggatcatcactgtccaaatgaaggcaacttctcaatttcctttttcctttctctacttcttgtcaccctcccacaaatgaatatgattacccatgccaagaatatacagcttagaaataagatcaggaagaaaagcaaaaatgaaaaagaaaggcctaggagaacaggaaagcagagaaagtgattaaaaagcagaaccacttgactgacaatcattcatacaataaacaaactctgtcagctgctctacaacaaatattctattaactgctcaatgttgttgtctctaattcttagaaccagtgtacaaaatagacattattattcccattagacagaacaggaaaccaagacaaagtgacttgcccaaggccacatggccagtgtcttagtccatttgtgttgctataaagtaatacctgagactgggtgatttataaagaaaagaggtttattcgactcatggttctgtactctgtaaaagaagcatggtgccagcatctgcatctgatgagagcctctagaagattccacccatgggggaaggcaacggggagctgcatatgcagatcacgtggcaagaaaggaagcaagagagagaggatggaggtgccaggcttttttaaacaaccagctctcatgaaaactaacagagtgagaacttactcattactgtgaggacagcaccaagctattcatgacagatttgcctccacaatctaaacacctccccttaggccccaccttcaaataaatttcaacatgaaatttggatgggtcaaatatccaaaccatagcagccaattaatggtaagttaggacttgaatcctaccctcaatagtaacaaaaatctttttttttttttttttttttgagacggagtctcgttctgtcacccaggctggagtgcagtgaggtgatcttggctcactgcaagctccgcctcctgggtttacgccattcttgagtagctgggactacaggcacccaccaccacacctggctaactttttgcatttttagtagagatggggtttcaccgtcttgatctcctgaccttgtgatccgcctgcctcagcctcccaaagtgctgggattacaagcatgagccaccatgcccggccaacaaaagtcttcttaatagtcccttctacttctctagactctggcaggtgtggggccctgtatatagaaaccgaggttggctcttgccctcaaggagcatattgtctaatgggaaggaaagacaaaagcaagtaatgatgatacaatgtgaaaacatgctctccaaggctaaaacaatgtgttttgggagctccaaggaggaaaggtctcaacccagcagcagagaaagcttcacagaagcagcaatataagagttgtgtactgaaggatgagtaagtttaccaaccagaaggccagccacagtggctcacgcctgtaatcccaacatcttgggaggccaaggcaggcagatcatttgaggtcaggagttcaagaccagcttggccaacatggtgaaaccccatatgtactaaaaatacaaaaattagccaagcatggtggcataggcatgtaatcccagctactcaggaggctgagataggagaatcacttgaaaccaggaggcagaggttgcagtgagctgagattgcaccactacactccaacctgggtgacagagtgagactccatctcaaaaataaataaacaagtaaataaaaataaaaagagttcatcagccagaaaagagggaaatgggcatccactattggggtagtcatgcaaacagaagcacagaggtaggaaagatcctcgcatgttgaaggtggtaaggtgggagatacgtaactgaactgtgagagaactagaaccgggctgaagagaaagaccaggggctgattgtgaaaatttttgtctgacgtgctatggagagtggggaagcttctgtagacaaatttcaggcaaaaagaggtgggtgaggcagctgctgcaccaggacggattaaagaagatgaggaataaaaacaatgggatgagctgaaggcacactcatggggtggggacatcctgggagacaaggacgtccaagtctgacatgaaacatgaagaaaagatgatgtctgttcaagagttccaatgaggcaaaacagcctactagagaaagcaattaaggatcctcaatatttaggattctgaagtgaaaacagaggaatccaaaaacatacataaagtaagaaaaagcgagagaaaatttcaaaagtgaaaatgatggagattagcacaagacctccagcagagatcaacagaacccaaaatataaatggtcaagactcaatattctatgttttaaggggagctgcactaagaggggtaagaaattgaaagcaaccaaaaaataaaaacaaacacactaagtctgttttagagataaggccattggaccatggaatacacccaaggacatcagaagggccatcaggcaccatcagtaagagcagatgatggcagccaagccaacttgagtagtagagatggttcatattactgcagggacaggggttaggcccacaaggtggttttctgcattttcccctgggagatgcatcgtaaatcatacacaggcatgggtgccagggtacaacccaggaaacactgagacctgcagtaacagcacaacttccttgtaatcttcactattgctcccatgatgctggctccaagtcatgactcatacttaggaatcaaatgttctcccagaaacactgttttaattacacatgccacttaaacagaaaggaaggccataccttcccattgatggaggcagaggcttaaagctcagccaatcctctgtctgaaggattcaggaaatttcccggtaagacaaggtagagaatgaacactatatctcctgctaaatgaaaggaaggacattggttgaccaaagccagagagacggaggaagggagggaggaagggaaagaaggctgatccacagatcaagctactaggaaatcaaggaggaattttaagtgttagagcttcaaggttcctcagagatcattttatccaacttcctgttttatagataaggaaaacgggccaaaataaggaaaacacctttagattcacataacacattggtaggagagagagggaagtggtggaacaagggtacatcacaccttcccattccaagatgctgcttttgccagggtctactatccaagtcctcagataaaccagccccttctttcaccagtggattcaaacccatgttggggaaggaaagagataaggagaagtaaatgggagataaagcagccacactctagttctggaatactccgaattattgattttggtggtggatggatggcccctttcagctgcactctcagcgcctgctcctgttttatgggtgtttccagtgtgcctcaaattatcttgcctcttatgaaaatacaggaacaattacatacaagcctattcagaagggacaattagctatttacatcagcaaagaaatgacagtgggctcttcctgacagatgccatcctcacactgtgttagagcagagagggaccttgttctggaaactgtccaatagctggaaggagacacctcctctgttattgtagtgtctttcttgcatttctgagcctgagctttctagacttctcaaaatgctatccagcaattggcagacccatcaattgaggatattggctcctcatcacctggtctcctttgggaggggtacacaggatagttgcaattggtttttaggacagccacatgcagaaacaaatggtagtcagactatgcagcagtataatgagcatcatttcctcatgatacttttatgatatagaaggaaataaagaagtgaatctgtggatggtaataaagtaaagaatagagaaacaatggatcaagatggaaaggaatgcaatgagaaatagattaaatgcataatcaaagcttaggaataaactcctgatgaatcaaaatgaccataatttaaaaacaaaaatagatctgctgaatttcaatttgaacaagccattcaccacataaaaaataaacatacagtatttcaatcttagaatttaagccctattttcaaatcaattaatcaaatactcatgcctgccaactctggcactagacatggtaggacataggagggaaagataaaataaaccagtatccttatccaaagtagctcgaaatccaatttgtacaaacaaggtgtacatgactgaattagtgaaaaggagaatttatacagtgagaagcagaagcaaatagggcagtgacacagcaacaccacatgtttcttctagtgaccagagtaactacctgagtgtcaattttctttgtattgaaaaaagggtgaatacagagtgacttgtgcttcactttaaatagaaaagtatttaatctatcaatgtaactttaaaagtcaaattgggcaaaactacaaattagtcttccatgctttagtctatatacctgtgctagagtgctctttccaaaacaaaaatctcatctcatactcttgttgaaagaaggaaagagggaagaagggagggagggagaaagggagggagggagggagagagggagggaggaagggaaaaagaaagggaaagggaaagggaaagggggaggggaagggaaggaagggaaggagggtaggaagggaaggaaagcaagggaatggagaataaaaaactttaatattccctcattgcttacaaaacaaaatccaaattctttagcatggtttataaaactcagtccagctccgtggcctagcctctgcctaaccaagttcattctcataatatgctgctaaatttaaaagtagactacagagcaacatgtacattcacactaagtgaataagcctgtcagagaaggggcaaatagtatatgcttccacttgtatgaaatacctggaacaggaaattcatagactcaaaaaagtaaattgaaagttactaggggctgggggattgggaaatggagagctattgctaagtggttagagagctcccgtatgcggtgataacaaagcttgaaaaatagtgtcgagctgtcaatagctgtacaacactgtgaatgtaattaataccattagattgcacacttaaaatggttaaaaattttatgtcaaatgttatgttacacatatataaacacaattttaaaaaattaataatgtaacataccaaaaaccattgaattgttcactttaaatgggtgaactgtattaactctatttaaataagctgttacaaatgtacaatatgtacatacaatactaatgtaggagaaaggcagaggaagattctcctaactgctaacagagattacctctggatggcaagatgcaggggatcctgttttctgagctttcctacatttcccaaatttttattagaactttgctttgtgctacttttgtatccataagagaagaataattgccatttttaaaatgttaaaactttaagcaagataaaaataagatataagccttaatcttctcccgttggggctcataacacatggtggtggaatgccagaagggaccctgggcactcagtactgcctgcattcttcttcgctgggtgagcctctggccacatgaatgtctgtgcttatgatgctggtggcccaaagagcttaatgatgcaaccagggactctgcaggaagactgctggagttccaccactcaccaagtacctctcatagcctatgtttcctcatcggaacaatgggataataatgttatttacttcataaggttatcaaaaaagtaaatgagataatttacatgaagtgtttaaaacaatgtctgatacccagtattctgacctaagtgtttcatcaatgattggcggctattatttttactgctgctgttgctctattacactgatgtgagtacagtcatgtgctgcataatgacattttaatcagtgactgtatataagacaatggtctcatcagattatagactgtatttttcctatatcttatctatattttgatatgttcagacacttaaatactaatcactacgttacaattgcctacagtattcagtacagtaacctgctatacaggtttgtagcctaggagcaataggttatctcatatagcctaggtgtgtagaaggctctaccaactaggtttgtgtaagtacactcgacaacgtttgcacaatgacaaaatcagctaacaacacgtttctcagaatatatccagtcattaagtgatgcatggctgcatttgttatctatcctctaccagagcagggattggcaaaccatggccaaagggccaaatccaacccatcacctgttttgtatggtccacaagctaagaatgtttttaaatttttaaatgcttggaaaaaacacaatagtatgttatttcatgacacacagaaattatataaaattcaaattccagtgttaataataaagtttaattggaacacagacactcctatttatttatgtattacctatgtctgctttcatgcacttgggacaaagcctgtctagcctgcaaagcctaaaatgttcattatccgccccttgacagaacttacttgctggggaataaattctgaaagtaaagaccagctcttgttcatttagagttaattcatggttagattagattggagttcatatttactgagagactaaatatacaaatggacatggccagaccatgtataacagaactctgacctacaacctctgcagcaaccagcctgggaagccaggccacaacctctgcagcaatctgcccagaatgatcagggtttagtcagtgactgccagcttccttactttttgtcccttcctccaaccaaatattctccccaaaccaatcatgtaagatactctgcttctagttagcccgcctccagcttcctcatgccagcaacctctgatcacagcacatgtatccgaaaccttctctttttcactgtaagaagtccaaaaagctttcccattccactgcctgcctttgagtctctgccaaacactaaggatggcagcagcctctcttgcaatagcaaactctgaataaatagcatctgtttggtctcctttgggtggtctttgtttatttccagttaacccggacaccccccaaagatacaatctacactgcctatcaccatggactctagtcttaaccaggagtggcacccatgaggccccttgtgccttgctgtttgcaggctctcacaggctgtcaggtctgtgacaacgtggtaagttagcactgtgtctgattccattctctgggcattgagttctttggctgtttattttcctcttggtaataccaggttttgttattggctcccatttgtttggaggaatcaagccattccttttcatccatgtttgctcccttttgtccttctattttgcattgtgctgtctccgtgttgtttgccatgaagacaatcacagggtagaacacaggcacaggccctataagcctgttgtctaagccggctttacagactgataattctgtggttctcaccagatcagcatccacttggacaaacgtttctgtgactcaccaataaaactggataggattctccttccatctctattttctgtcctgagagcttggctctaatccagagagaacattctctggttttcttgttgggagggcgcagattgccaggtcagcatttgaaggcatccacttgtgaggtgggggctctgagacactaagcaaacaagcatcactttcaccaactgctgggacctctcatgggattatatgtaagtctaattcttctccagaaaaaaactcttgcttcttatatgtactgtcactacaatcctaattattgtgcctatcatacctcatttcatcaatgtcatcttcagtggatactctaagcaacatgagccttaaacaaaactgcttatttgaaaggggcttaggggaaaaagggaataagattgctcaggcccaatgggcagcatttttttttttttattagcatgcagaagcctccaaacagcattctgattcaaaatggttcacaaaagattatttgaacaatcttaaataacacaaactagattcatttccctagtaaattctcccccgccttgtcttttagttgcctctctatacccagtgccctcttcccccttatcctgatctatctccttctgcacctctctcaactcttctctttgtcaaaactcccttccttttcccaacaactctcctaaggccccaagatgccacttgcatttaaagatccatcccacccatgggccaggcattcagaccactgtggaatttaaaccttggtcttgagctgaatgaagagctagcaactatttatagaagaatcctagacaagaccagccactatttatagaagaatctataattcttttgagtgcatttgactcagggttaccaaactttatcaagctgcaaacattgattggaatctaaatcctgaatagcaaaagctaattggactatcccagaaaaagatctatggaatttctcttttcacaattaaaaaaaatcaagagctgagatgggaggactgtttgagcccaggagttaaaaacaaaaacaaaaacaaaaaaagaggttgaggtaggagtattgcttgagcccaggagagactccatctctctttaaaaaaaaaaaaaaaaaaaaagtgtaaaaggtaggacaaatttttctaaaagtcatacccaaaacatttccaataaaagtagacttgaccaaaaactatctactgggtactatgctcagtacctgggtgacgggatcaatcatactccaaacctgtgtatcactcaatatacccatgtaacaaacctgcacatgtaccccttgaatctacaataaaagttgaaattattcttttttttttaaaaaaaaaaaaaaagcaaatgtagaccagctaagatcggtcatacatcatgggatattaattatcaatttctattgggtaaaagttcaggaatattcactcagactatttgccacctcttttcatggtttttcagagatcattggtagctcttaattgggaaaacatttagccccatttattggaaggatataaaataaagccaccccagatgttttttaaaatagacttgaccataatacagtcataccaacagacaaaagattaaactgtaggagatttcaggctagacgagaagataaccttcaacaacatgcaagagttaaaggtgctgatctaacagcagctctttcatcttggccaaaagtactaccattagtccttatggccatgcaatccactccctcaaggacacattggctatcctcctatgaatgggtaattggaaggcccatgtgttcagggatttcatctcgaattctagtagttctgtcctgctgcacacagatgtggcaaaatattacaacggaatcatgtactatgcccagcttgtcaaaaacaggttaaggcccccttcccacaacatcgtcctaaatagcatctttataatcttcttgtctattgagaaaaaaaaaatcagaaaaaaaaaacctgtttttgaatcttgttggaagagaccttatccggtactgttagcaataaatatagcagtgaaattctaaggagtcaattcctgggttcacaactacagaagcaatgcagaattccacagaactggaaggctactccataataggacctcaagggaggattctcagagatcctctagaagtcgccagctttcagaagcacacagctgatgacctcacataggggacagcttctacccaaggcagcgggccaagaaccctgtctaattctggttttgtttttcatccacctccacgtgatcattcttctcatcttctgtagagtcctagttgttgtccactcataatggaactttttctctgttctttcctcttctttataatttttggttcagaaaatactcattcttagattatcccaaacagtacccactcctttgatcttactgatttctgaacacactgtctatcactggatccccatgataaaatcctccaggcaattccagtctcatgcaataagaccataggaaaatacagtcaatggcatctccatttacacctataggaacaaatgaccttaaacaaatcaacctatgactttgctactctccctctctgccacaaaaaaggactaattattacaatctattattcagactctagtcccacatttgaattcaacacatttcctacagtgatagtacagatacttgctacctagaggagactcttagagattcgaagatgtaacccagctaaccagatgctccggttgtaactttgtgtcataaataaataaatctttttgtcctgtatctccatgagcacctactggatactactttttttttttttttgagacggagtctcgctcttttgccaggctggagtgcagtggcacaatctcagctcactgcaacctctgcctcccggattcaagcaattctcctgcctcagcctcctgagtatctgggactacaggtgcacgccatcacgcccggctaatttttgtatttttagtagagacggggtttcaccattttggccaggatggtctcgatctcttgacctcatgatccacctgccttggcctcccaaagagctgggattataggcatgagccaccacgcccggcctggatactacttcttttatggccaagaagcctaatcccgcttgcctcagactaatacctcatgcactttaggaatcatattccaagacttgtccaggcacagggactgtaagtctataaattgctaaggctgtatgtcaactccaaaataaggccacccttgattattcaggcactccacctggggaaattaatgactcattctttatgcaaacaatcagagcagtgttcccaatgatggaaatcttagaaacatcaggaagaaacctattgctaactctggcaaaagttattaataatactacctctgccctggatggaatacagatcattcccaattcattggcacagatagtgatggacaattgcattgctccggatttcttgttggctggtcgtggtggcatgtgtgtcattgctaatactgccttttggactgggatcaaggaagtaggaaagacagaacagactaaacactgcctgaaggaaacagttacttggctttctaaggttgatcctcatggcctatgggatttgttctcttggccttggttaaacaatttgtgttcctgatttgtttgtttgtttgtttgttttttgggttttggtgggggtttttttgtttttttttttttttttgagacagagtcttgctttgtcacccaggctgtagtgcagtggcgtgatcttggctcactgcaacctccgcctcccaggttcaagcaattctcctgccttagcctcctgagtagctgggattacaggcatgcaccaccacacccagctaatttttgtatgtttagtagagaaggggtttcaccatgttggcaggctggtctcaaactcctgacgtcaggtgatctgcctgccttggcctcccaaagtgttgggattgcaggcatgaggcactgcgcccagccttgcttccctggttctaaagcagcttacagagactattaattgttctcatttttgccacagtggtcataatgttacttattgtgttctatatggagccttaaatgcttctgcacaaccagtctcttatcaaatgactgccatgattgaaatatagtttactacggagacatctggataatttctgagaagtgaagattcagattctggcttttccagaattggtcagccactcacaagccagagaacgaagaaaagaaaggactgaaagaccaaataggcaaaagaacatagccagactatacaagacaatagaacactgtctcaaaacctctgcagcaaccagcagcaagagccaggatttagtcaatgactgccagtttctctattctgtgcccctacttccaactcagggcctagaaaaggaagccaaatactgcacttttaattagcccatctgcagcttccccaagccagcaacctccaatcaaaaggatatatatacctgaaggctcccctttttggattgtaaagctttctcactctaccacctgcctgtgtcaaacacgacaagtaatgtaagcttcctctcttgttatggcaagctctgaatcaataacctctgttctcatttgggtaatcttcatgtatttccacactacacccaaccacatgcatgcacacacagttaaaaatggcagggccttgtgcaagatactagaaatcccagcagccatataaagagggccacttttcagtgaggcagtacattctcacctctctaccccacctcccaagggctcaggttcagctgctaccacctattaatatcccctcccttggctagcctgtcatcccaccactgtacccaggctttgctcagacctatgtcagggcatagccacaaatgggttaccagtatgactcccatgccatcaccctcagcaagcatctctagccaggctcatcctcatatgctcaccccagactgacatacaaatattaccatcttctgtatacgctattgtttgagaagcctaggaaagcactaaggagcctctgtgccacccagccctgggatctctcatgctgtgttttagcctctgccctgggaaggaatttgtatgagtctatagggcttcaacaaaatgcccaaatgagaggcatatgttgcttgatgggaaagagagttgccccacaagaaaatgagctaaagagtctgtggttagaaggtatttcatgctttcaaattctgagaactgtacaagctgcaatgtgagtccaaacagggagagcccttatattctcacattcccactgatggtaaattatattgattaacattagcaacattaaatcatattgctaaggctaattattataacaatacatcacctaacattaaatgaactctcactatattccaggcacaatttctaaatacttcacatttttttaatcacttaatcctcacaacagcctgagaatgcagacactattaatgaacgctttgtaaagattaggaaactgaagctaagaaaattataacaaggtggccaggtgtggtggctcacacctataattccaacactttgggaggctgaggcaggcagatcgcttgagcccaggagtacaagaccagcttgggcaacatggcaaaaccccatctctacaaaaactacaaaataagccaggtgtggtatcgcgtgcctgttgtcccccgctactcaggaggctgaggtgggaggatcacttgaatccaggaggtggaggttgcagtaagctgagatcacaccactgcacaccagcctgggtgacagagagacactctgccttgaaaaaaaagaaagaaaagaaaagaaaattagagcaaggtcatacagcagaacaggagctagaactgagctctaatctgttagacttcatactctgagctataaccgctaattcacaatgctacttaaaacccatatttgactgaccacctaactaagcaactcaggcaggatggcgtaatatgaataataacaaatacatacaagaaagaagaaatgtatcattattcagcaactaaaaagtaaattctaatttatatcaagtcagctgttaatactgtatcaattctaattagatacttgtgttgtactttgacaaatacagaatgtaaattcttttagtgcttcaatttactgtggcttttgaattaactttgcatcagcaattgtcttccaaattatttgagataaccactaatttcatataagtctattttacacaccaagacagcattttatcagcatttttcagtctcatattaatgagaatttaactaatatatgtaaatcacaatgatcctataaaatcacatgaaagccaggccgatattcaccaaaaaaatctagaaatcacactaccatttgtgtgttatttcagaagaagtaggttcagtaacttgctacttttatacatagtcaatttctataagctaaaaagaaggaggaatttgaaagtcagttgtctattcaatcttaggatgtgttacttcctaaatttgaatacaggatatgaacaacctgggacatcactgtatcacaaaagcatacttaaggctcaacaggggattagttggagagcttcttggctttcccatctcaccatcctcacccctcccaatttcatgctggaaacagacagcagcacattggtgtaaagcaagagtcagcaaatttttctgcaaagggccaaacagtaaatattttagtctttgctagccaagaccgtctctgttgtaactactcaactctgccattgtagcacaaaagcagccagagacaataaaatgaatgagtatgactactgtatgaactttaattattttttatttcctaaatgttatgtattcatgtgtttattttataaattttatttatggacatggacatgcgtatttcatgtaattcttgtgtgctctgaaatgcattcttttgtgggtttttttaaaccccatttaaaaaagtcaaattcattcttgctcgtgggctatacaaaaacaaaaggtgggactaacttggacctttgatcctcgttggctgactgctggtctaaagaggagttgtcccagttttcctttataatatcatcttcaatcaagttcacaccttgcatgcccacccctatgcacagaggccatccagtgtttttgtttgtttgtttgtttgtttttgagactgagtctcgctctgtcgccgaggctggagtgcagaggcgagatctcagctcactgtaacctccaccttccaggttcacgccattctcctgcctcagcctcctgaatagctgggactacaggcgcctgccaccacgcccagctaatttttttgtatttttagtagagacggggtttcagcgtgttagccaggatggtctcgatctcctgacctcgtgatctgcccacctcagcctcccaaagtgctgtaattacaggcaagagccacagcgcctggcccagtgtttgtttttaaacaataaatatagccaacactttttacatatgtattacttattacacttagtacttgtgatgtacttactctatgccaggctatgtgtgaaatgctttgagtataccatttaatttattcctcccctagaccttaaagatgggttccatcattatctccatttacagatgagaaaactgagcctaagagaggttaagtaacttcctgaaggtcatgaaaccagtaagtggtagggctaagaagtttgactccacagcccctgttatcagtacccactattatgtcatcctcaaagcgcttctgtgggacagaaggcaggaaagaagagtaaaaatcaaccaggatgcttgttatttgaagaatagccagcaggagacatcaacagagcaaaggctacaaccaccaacacaatacagaaagctcatatttttacatttcttttgaaaaatgactaatcctgattatctcagtcttttatttaatggtgaatactgccagtttcaatgcaataatatttcaattcaataataaactactaagcatgagggactaaaatctaactgaacatctattcagtgtcttcctagtttatacttctttgagatggatgagagcagccatccctgtattcttcctcagtgcttgcatcaagggaggggacccaggatgctcccaaaattaccaggttgcatttgtccaccacaagggagaatttacatagtaatctctccccaaaatccttccctctaggaaaaagtctccaaacttctcttcctagaatcaggaggccagaatcctggagccagggctaagcatgggagagcgggaaagggatgaagatgccaagggaaattagatacagtgaaccctagcccaaaggggctcccaaaacatcagttctgaataggtgggaagagagtcaagaaccaaatctaaagtcaagggtccccagtttgggtcaggcaaacagggtaggcccagtaggaggaagacactggtggctagagaagagagaatttttgttgaggttgagcctattgcctcattcattccttcaacaaatttgtacgaatatcactttgtgccacaactctaggccttggggatacagcagtcaacaagacaggcatggttcctgccctcattgggtttataggctgttgatggaaggcaatccaatagtaataataaaggtagaggaacatacaacgatgaaacactaaatcttatagaaatactagagggagagaatcattaagggtgctgtgttaggcagcttcgtaaattgttcctaatactctccacctcctggtatgcatgctcttgtgtaattccctctacttgattgtggcctcgatctagcaacttgcatccattgaacagaaagtaggaagttattaaaaaccatgatttctgccagcttacatcctctctttcttgctctctcttgctcaatcactctgagggaagtcagctgttgcactgtaaactgccctatggagaggctgaagtggcaaggaactaaggaagacctccaggtaacagcccatgagaaactgatgccctcagtccaatagcccacaaggaactgaatccttccaacaaccgcatggatgagcttagaagcagattcttccccagtcaagctttcagatgagactgcagccccaggtggcacattgattgcaacttgtgtgaaaccctgagctagaggatgcagctaagctgtcctcagattgctggcccacagaaactgtgagataataaatattgttgtttaaagtcagtaagttttgaggggatttgttataaagcaataaactaatacagattccaatccaggttgcccagaaaatatctaccaaactctctcagacttaccctgtttctcacaagagaaacagattatagagcatttactaacaaggcccagaatctctgataacattggtaacattgagattgatgttgcaaatggaaaccatccctctcaatgggtgaggctgagctggctccagctgtgagacaaagaatcttaattgctcccaaaaaaaaaaaaagaggtgagttggccgggcacagtggctcatgcctgtaatcctagcactttgggaggccgaggtgggcagatcagaaagtcaagagtttgagaccagcctgaccaacatggtgaaaccctgtttctactaaaaatacaaaaattagccaggcatggtagcacaaacctgtaatcccagctactcaggaggctgaggcaggagaaccgcttgaatccgggaggcggaggttgcagtgagccaagattgcaccactgcactccagcctggacaacagagcaagactctgtctcaaaaaaaaaaaaaaatgaggtgaaagaagaaagtccctcttttggcaatgagctaagagtggggcagattaagaggagtctagtagaaccagaacagagaaaagtacagtaattaaagaagtcgcaatacatgggaggctatttctaaaatatcatttgggaggcaacagatgaactgacttacccagattcggtttttcaagggtaagaagcacatgtaattataatggtccttcagtgctcccacagtatcctgatgcacctccccccatcacgatcccttaacatgcttaactcaatgaactgtttactgtcctgtttctccgattagaggcccaatgttaatatcaattaccactgtatcctagtgtctagtacagtgcctgccacacagtaagaattcagtatatacttgtcaagtgagtaaaatataccagttttgtgacaaaaaatatgcataggaaaaagaccagaaaggaacacatgaaaacataaacaatcttctactagatggaagagtatgatccttttccttgatatacgtgtctccattttgtctgcacatagacttgtctgtgcaatgtctataatgcagagaaagaaatgcctgaggatgccataagacagatcttttgggtcctacagagtttactttcataattttataatattaagattgttgccataaatttccaaactcaaagacatttatagtagattatcatctcacttgtcaatttgtcaacctgaaaactgagttcttaagcaccatgtagaaactttcaaatataagttaagatatcaacacctgcagagcaatattatgcataaagatgtaaaattaatcatttcacacattaggccccccaaaaaagataacaaatgggagatcatatcgtattaaaaataaccatgtgagattctttggattgtgcggtagcacagctctcaccaaacttcaaaatactctggaattcgggtgcagtgattcatacctatactctcagctactcgggaagctgtggcaggagaaccacttgagcccagtagttccaattcagcctaggcaacatagagaaaccctatctccaaaaaaaaaaacaaaaaacaaaaacaaaacaaaaaaagtatcggagcatccaacctagcaagcaatattgccccaaaatgcaatcaattaagtggaagattttgcatgcatgtatgtgaatttcacatttttatcctgagtcaccagatcacaaaaccagcaagctcaatcttcttgaagggagcagatcgcccgcccagaagctcaataccttccatttgggaacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcttttgtagggacatggatgaaattggaaatcatcattctcagtaaactattgcaagaataaaaaaccaaacactgcatattctcactcataggtgggaattgaacaatgagatcacatggacacaggaaggggaatatcacactctggggactgttgtggggtggggggaggggggagggatatcatcgggagatatacctaatgctacatgacgagttggtgggtgcagcgcaccagcatggcacatgtatacatatgtaactaacctgcacaatgtgcacatgtaccctaaaacttaaagtataataaaaaaaaaaaaaaacaaaggcagcaatctgaaactggttctcaagattgtgctctagatttatacagatagaaaacattttttccatataattccaagttcccaaaagagcccaaaatcattcatatgtcccaagtttagaatgtcaccaaataagccagatgaattgagttcagagacaggctcccattcctgccttgtcatgactataccagcagtgtgccagaaacagttaagggacacctccactgcaacagaggcactgtgatttggcagatgtacctccattcgagaaccctggcctcttaagttagccctgcacagtccaatggaagtgtaatgcaagccacatgtgcaattttatattttctagtagccacattttaaaaatataaaaacaaataggtgaaatccatttcaataacgtattttatttaacccaatataccaaaaacagtgttttcgcaacatgtaatgaatattaaaaatcactgatactttacattcttttttgttgtattaaatcttttaaatcccatgtgtatgtcatacttaaagcggtcaattcagatagcccacagttcaaatactcaatagctacaggtggctactgagtattgagtataccatattggctattaagtataccatactggacagttcagggtaaatgcacttatcctatctgactactcaggagagaccttcttgtgttattacttatgaagatagctcatctctcatgaatttaagtcaaagccaaccatatagagatgaaaaaaaaccaaaataacctggtgtagcttctattcactggtgaaataatatatactgaacaccttctctgtgccaggcactgagccaagggctttacatagctcactccatttaatgctcacagcaaccctaagagaaggtacaactgtaatccccatttacttatgatgaaactgaggcatagaaagttaatttccctaaggtcacacttcaagcaggtggtgatgcttggatttcaactcgagcagtctgactctacactgcacactctacccactgcacatactcaacaagagggagtaaaagaaggatatgaaatgcacggttaagaaatcttagtctgacatgagtgtgcatatcagaaaagaatcaagaaagtatttgaaagcctgcgacagaaatctaggcttgagatacagagataaattcacctacaaggtaaggaagggaagggaatgaaatatgttcaacaggaaaaatagaattaagaactaactaaaattttgtgtcaacaactgatgacgacaatgatgatgatgataagaactaacatatttggagcctttgctctgggtcacgcattgttctaaagtcagtttctcagcctcagcattatgaacgttagggctgagtaatgattgtaggagctgtcctgtgcattgcaggatgttgaacagcaccccgggccccctcactaaatataaggaacagcactctactctcaattagcaaacaatcaaaaatgtctctggccattgtcaaatattcccctgggaagcaaaattgccccctgttgaaaaccctcaatctgagtgtttcatatacattatctcacttattcttgacagcagacgtctggggagacatgattgctttatagatcagaaaactgaaggtgtggttgggcagctgacctgaggtcctgtcgctaataagtgaaagagctagacaaatccaaatttgtctgattctaaagtatatttttactgctagcccccagtacaagttctcgtctcatctccaattcatacagggatttgtgtgctttcccactccctgggctgatgctagagatgaacagaaacaaaacactgctggacactcctcaccgagaagttctcctgccacaatcaccttttgtgtctcctttccaccttgtgtctcttcgctctatttggacccacgttttcttggctaatagcctttcaggaaataggcatggtatgaatgaacagataaatctttaaagcctgaatacatacttatggagaacgagtcctcaaactcaatacaaacatccaaccaactgcaattaaaagccacaaatatgtttttataagaaaattaagctatcaccatatcatctttgatataaagtgagatatgactaaaaatggaggtaaagttcaaattgctacaagttgtaaatttgttcttgaaatatcaaacacatgggaaacagaagctaattattttgtcctatttttgtatgtgaaaattacttataatctgcctgttaaacaattcaaaattattttaaatgataattgaccatcaaactaggccaatttacacctacaatccctctgaaattgcctagaaactgggacaactgcagaagaaaagaaaaacacttccatttgcgtcaatgtctttgtttttcatccatcagtctccaaggctgcaaaatcagaaaagcttaagcacaactgattaataaggaagcactttaggactttgcattatttgattatgccaagaaaaaccttataattctcataaattcattattccgatattggtcatgaggaagtctactttttaaagaaaaaaatggggaatttcttcttataacttcattgtcaatatttttaaagtattatatgatttgtttaatgcctttaagcccatcccaatgaaggaaaagggcatttgttttcgtattacaatcattcctgggtatacttaggggattggttccaagaccccctatgcataacaaaattcacgcacactcaggtcctgcagtgagctgtatagaatctgcacgtacaaaaagttaaccctccgtattggcaggttttgcatcctgtgaatactgtattctcaatctgcattcagctgaaaaaaaaatccacgtgtaagtggatcctcacagttcaaacccatgtagttcaagggtcagttgtaatttacttttaaaaaaaaatatgttagccagttgcagagaatagattcaatagcagattcttcttagtgtctcaaagatcaacttaaggagaaagaccaaaaggagggaaagcaaagcagagagggaggggaacagaaacaaagagacaaagaaggaaggaaggaaagagagagaaaggaaaagaaaaaaaatagaaaaaaagtaaggtggaaaaagaaaaaaaggggggggtggaaaaaaaccaggcaaagtgatctctgatggctcatgagagactctgatctccctatagctctgtatatcccagaatctgaaattctcaaaatcccttcactgtgcattctggaactcagggtcctcaagaacaaagatctcctataccctcaacctcttcgaaaatgatagcttccctttcctgacttaatccattcacctttccacccttgttggcaagtacttcataccttctccttcaaagcttcagcacctctttccccatactcacttttaactattggccttccttcccttttcacccagaaatggaaaccacagaagagaatttcctttacctgcagcaccccatcaactcacggacttgcatctctgcccagatcctctgccatccctcctgtaactctgggtgccccaacacgtgtgcctacccatagtagcccctcctcttgtgtactagatcccatcccacccccctgctcatggataccactgcagcagtgcattttctaccaggtcagatcctatcagcagacaaatatatcatcatgtctctcatctcaaaaaggccttctcttgacctctacttctttctccacctaccatcctatttctctccattctttatagcaaaacttttagaaaaaggtgtccaggtttatggcctccaatcagaatcaaactttccccccaccatttccccaaaatagctcttagcaatattgatgtcattagtgacctgaataaatccaatggtcaattttcagttttcatatttcctgatctatctaaagtatttgaaacaaatgatcatgccctcccttgttgaaacacttttcttcatttgaccttaaggataccacactctcttgtttcattccaactcatctactcaacctcttaatgttgcaatatcgcagtgttcattctctggccacctttttttctctatatatgattatattctatattatactcacctttttcatgactggatgcaatctttctgctaatcagtcccaaatttataccgttaggcttgctatctcatccctggactcgaaactgcaaagccaactaattaatcatcttcacttggatgtctaatagataccccaaggttcagatgcccaaaaccaaatccctgggtttaccctccaaatctgcttccttgtactttcccatcagtaaatgacaactgcatcctaccagttgcccaggccccacaccttaaaatcattcttaattatgttttttttcccatcccacaatcaatccatcagtaaatctacccagctttatcatcaaatactgccataatctgaccacttctcaccacctgcactgctcctatcctggtgcaagtcaccaacctccttcacctgtactgagcatttgtctccagtcttcctgcttctaccattaccttcccatgcttattctcaacacaacagccagaggaatcctgttaaaacatcccatcgcccttctattcaaaaaaccccccactggaatttcacaaagagcaaaacccaggtcgctaaaatggacaacaaatccttccatgatccggtgcctttccttctaatcctgtttcagacttctgatactactaatcaccatctcacatcccacatactacactttgttgctgtcactgctataattattgtctgtatgctccactagcatataagctccaggatgagagaatttttgtttgtttcattcatttatatattcccaacatctatcacagtgcctggcacatagtggatactcaacaaaatgtgctgaatgaatgaatgaatggaactctgagagtcagaaaagcatcaaatcacatctaagaactagggatttaatctcatccctgtcattatggccttactctttttttaattgtgataagatacacataacctgaaatttaccattttaaccatctcaagtgtacagttcagtggcatcaagtacattcgcattatgacacaatcatcaccaccatccatctccagaacatttttcatcttcccaaactgaagctccacacccattgaacattgaacaatatctccccattcctttctccctccagcccctggcaaccaccattctgctttgtgtctctatgaatttgactactctaggtgtcacatttaagtgcaatcaagcaatatttgccttcttgtgactggtttatttcatttagcataatgtcctcaaggttcatccatgtcatagtatgtgtcagagtttcctttttataagactttatatatataaacacacaatagaatattattttatttatccattcatccactgagggacatatatttggattgcttctatcttttggccatggtgaataatgctgctatgaacatgggtgtacaaatatctgtttgagtccctgcattaaattattttgggtatatatccagaagtggaattgctggatcatatagtaattccatttctaatttcttgaggaactgccatactgttttctgtagcagctgaatcattttctattccctccatcaatgcacaaaagtttccatttctctatttactcaccaacacttgctattttgttttttgtaatagccatcttaatgggtataaagtagtatcttactatggttttgattcgcatttttctaatgactagtatgttcagtattttttcatatgcttgttggccatctgtatgtcttctttgtagaaatatctattcaagtccttttgcccatttttccatcaggttgtttggttttctttgatgttgtcaagttatagaagttctttaattattctagatattaatcccttaacagatatatgatttgcaaatattttctcccattctgtggactgctttttcaccttgatagtgtttttgatgtatgattttaaattttgatgtagttcaatttaactattttttcttttgtcacctgtgcttttggtgtcctacctaagatatcacttccaaatctaatgtcataaattttcttgtaaatgttttatggtttcaactcttgtgtttaggactttgatctattttaattttcatatatgatataaggtaagggtccaacctcattattttacatgtcccagtatccagtttttccaacaacagttgttgaaatgatggtcctttccctaatgaatggtcttagcacctctgtcaaaaattactggatcatatatgtgacagtttatttctgggcccttgtttctttgagtaagtcttctaagctctccaacctccattcccaaaaatgtgaaatgaatagattccaccagtaaggatgtatcttattttgtcttggttactgtaacaaaataccataaactaggtagattattagcaatagaaaatttatttcttatagttctggaagctgggaagtccaagatcaaggtgccagcagatttgatgtctgctgaggggttaccttttggttcatacatggtgacttcttactgtgtcctcatattgtagaagaggccaagcagcaatctggtgcctcttctataggggcactaattccattcatgagggctctgctgtcataatccaatcacttcccaaaggccccatctcctgacaccaccacattggtggtgagtggatggaaaatacagccaaagtcctttctccaccaccctaagtatggccagcattaatgatttccccaaccaacacatggacaccatacaccatataccagatttgagcaactagtgggtgaaaacggaacatgatatgtgtttcttaaatgccttaatgttctagtagcacaatcatttatgtaatattgaaatctctacataaaaatatccacatggccatttgatctatgttaaggcacctcctccactaatggggaactcactaattttagaggaaactaattccatttatttaaaactttggctattaagacaatccataaacatacatattctttttaaatggtttgctttcttcagctatgttattagctcatttgggtccctttaagaagactctctaaagacaccaaggctggagaactaccatgaatgggacagctataaaatgagtaagaacagtatttgcagctaaatggcctgaattgcagagtagagtatgagatgtaatttggttcttagggcatccactgtaaacttggatctttgccaaaaggaaagcattatgaactactgatagacatatggcttcaaagtcatctcagttttgaacaagtaaagacagaatggaaagggttggttcagtatgaataaaacagatgaccccaaattacctctcaagagtaaattcagctctataaaaattagagatccagtggcaaggattaggaaaacacttaagcaaagctttgtacctacactgcaaagccacagatcacttggtaggacaaagtcaagaaagactcaaaactcagtgacagcaaaaaacaagatgtcaacttcagtgtattctacattaaaataaatattaacagtaataattaagtcacagtgaaacactccaagcatcccagatttctttgactttcgttcctatgatggttatggagatcagttctgattacacttttcttttagtttattttgatggaaagaactggatcatggaattatccccaaagcttcccaacctgggcgatcctccaaaccctctggagaacttttgaaaatatgggctccacactagacactctaaatcagtatctctgcagttggattttgttgtcttatggggttgtttttgtttttcttttgtatttttgtttctgttttttaaaatttccccaagtcattctgattataagcagggcttgggacctgctggtccagaccccatacctctactggttttcctcgctggaaagaccttagtaattggctctgcaaatgaagagagcaccagtgacattgggagacactactgctactgaaaatgataaactgctaggtcacatagaaacatggagaactgtatccaatataatgctaattatacagcaaatgccagatataacaccatatgtaagacttttgggcaggtaaaataataggtacagcagaaactctttcattccatatgaacagcatataaaagtggttgcaacagggcctgaagccttttgttggcaacaaggagttgcctagaactacctgtgagagggacctgcgtggttttcacctgggtggtgccattactttcaatggcaaaaactgtgattattttggcaccaacctaatattttaaaatgtgctatagtgaaatagcatctatgtgaagtgcactaatctataagaatttaatatgtgtattaaactatgttcaaattttggctatataataaataaatataggcattagagaatgtcacatcaactttaaaaacacaaaaatgctatgagctgaaattatttataattactatgaaagtgtttaaccaatttgttattattgttatagagccccaaaacctctgttacaaaattcatcagtttggtctctgtctaattctgcataatcctcaaggattctcatcacattgtgggtgttcttggcttctctttaacctgtacaatgcaaagtgatttttttaattttctaaaatgaacacactaataaaatgggcagtggaccatactaaatattaactccctgctgtttgttctctcttgtttatttgactattcagattctctgccatttgtgtctataaaacccgggattaggtcaggcagatgcaggacaatattcgttcaccatgacaacactgtcgcctttgctaatgcatccaagcccttggactgccttcgaaaatgacaaggagattttataacctctctagttgagctcttctcaccacctgaacagagacaagggtaatcaaattccatttcaaagaagaatatcattgcccttctttcacctctttcttttccaagagtgtccttgcaagatgcgtatgacccagccatcaatgctaaagagacatgattggataaggagacagagcaagtccccctttaccatctctaactctcattttcaacaatgactccctgcctgtgactagaataatgtggtgtgttagggaaagttaaaattaacagataaatatcttcttattacacatttgtagagagagataattctcaaagataattcctgttttcatcttccattctatttctccccatgatcattccattccctttaagacctttccaatatcatatttacatatacaaatcctaactcatcattttcataataaatatttatgcagcaccaacatgggctaaggactatgttcagcactgagcatacaatggtgatacagtttggatgtttgacccctccaaagctcacatcaaaatgtattcctcagtgttggacgtaggccctggtgggaggtgcttggatcatggggacagatccctcatgaatgtcttggtgccattctccgggtaatgaatgagttctcactctgtgagttcgtgctagatctggttgtttaaaataacctggaacttcctcctctcccccttcctcctgctcttgctatgtgacatgctggctccccttcactttcagccatggttgcaagcttcctgaggccctcaccagaagcagatgccagcatcacacttcttgtacaacccgtggaacaatgagccaaaataaatgtattttctttataaattacccagtctcaggtgtttctttacagcaatgcagactaacacaaatggcatccaagagagtccacagaccttgccctcatgaggcttgaagtctagacttccaatggttacttcaaattacacctcttctcagaggccttccatgattcctttccttactctacgttgtcacaatactctacccacactgtacttttggtctgtatcattttctactttgtacggcaatcacatatatatctaatctcctctgtcgatccacaaaaagtgtaggccctcattcatttttgaaccctaacagcaactcagcattcaataccttgcttataggtggcacgccccaaaaaattatcaactcaataaaacacacaagggagcaggaatgtatcaacctttaaaatcaacattaattatattttcaattctaaagagaaattacagacagaaagagaaatttatgaaaattatggagcaaagcattcagagtattaggagtaccaaaaaaaaagagtacaaaaattgtaatgcatattttatagaactcttcctgaaatgatgaacaaagaatagctcactttcccatctaaatacattgtagataaatgggaaaaagcaaaaaatataagccagttaagcaatagctgttaggttgaaagtattgatcattgggggactctattgcatgggaggagggaaatatatcaaggagtttaattaacaaatgctggagaaatcgtgctagtcaaccagaccttgaggcatgagtcagacttcacagagaaatagtgtaaaatgcagagaaaagccagactcactatggaatgatctgcagtcttttaaccacaagagtcagtgtcacagaaagaacatgacaaagcagtgcctacgatttccagagttacatgcgaaatactgtttccctgccagggaaaccccagctcatgacagtggcatgagaatgagaaaggccacctgcaaatgaaatgagaccatcccacctgcaacagcaggagagggccacacatggtcttgttagtgccatttcaggagttgtgctgcagaaccagggaggagaccagacattaggtcaagcctgtgatctcaagggagctggcctgctgcttccccagaggacttcagctagagtcagtggagttaataaatcatgtaactgtctggtcccattatctcaacccatctaccctttgattctgctgcttggaaggaattcccagaaatcaagaaacccaggctgagaacccatagatgtcattctctgagtaaacagatgttcaaaccttgaagaacccggcaggaatctgccctgcctttaactaggaagggtaggcccatctagatggagtccaagaacaggcaacagctatataaatctaacttcacaaaggttgctaaattttggtagttaaatctacagctgactgtgaaagggagccttaaatagggctgaaattttaacaatgaaaaatcatttagttaataattcctttttccattctaaaccagtgacggccaacaaaataaatgaccatgttgaactcaggaatggaataatatgttcttacaatgaaaaaaaaatccttttctgaaaacctctctcaacagcacaaaatgccctattagaaaccattctttaattagcttttccatcagcttttccatccactatattttacactgcataaaatacccatcactcaacttcttagaaatccccccactgagtttcaatggaaaaaattacaaccaactcaacactgggtttccaataatgctcttatttctataccaaaaatagaatttcacgactttcttctcctagcttgcttttcaaactaaactaacactaggtcattctcccctgccccttacctaaatggttgagtgatgagaatgttataagcgatctaacagtgaaaagcaaaaaagggcggcaaaggagagtgattggctaccttgtacactgggtttaggaggattctaaagccaaaactaggtttagaggggaagtctcacgattagtgatgtctgccatcagaaccaaaatggagaatggcagtacaatatttgtcattggggctatctataaatacaatagctggatatacagaaaataattgaggtgcattttcagtagcaagaagattcttaagttatctttggttttgtttttaagagttagctggttcatatgcaacataaacaagagttcactacctggcctaatgaaggggttggattatcatgccacagaatattacccaatgctttgagctgaggtcacatccaagattaacaggaagcactactcataaggacccctcccagggtggaagagaccatccacttaagggtggactgtgacagcctaatagagctgtgagcaaatgtgttgtgaagaaaatgcactaactgaagcacctgcttcaatttctaaatgtgactcataccatgtcagactgatccctgagctttagtttcttcgtcagtttaatgggaacaacagctcttgcactcatctcaaaggatgtgttggggattaaaatgagaacttaagtgaagcaatcagaccacaacataccttcaacaacttcagtctcactcatgggagatgttccaaaaataaatgctgaacgaggttccccataccaacacttcaaattattctccactgaaagactgtcataagaaggaggaggctgaatttcctgctgtgccctggaatgagatcactgtgtcactccatctaagttgcctggtcacaacttccaatgtgcaccattgactacatcctcctcatcagggaagggataagaacaaaatgatacctgtgattaacttctgcctagaactttatagtttatcaatcattcactctgagaagactctcacatcaactatgaggtattaccaccatttccattttaggaataagaagagtgagaaagagaaatggttaaggggttaaggaatgggaggcaggaagaaggctccagccttattctaaataccatgtcatgtctacgtttaagatgagtattagcaactcaaataagtaggtgaactgtgacaatcaaatgacaatcctgggttcactgctaccacttaggaagggatcagagaaaaatgagttttaattatagaggtagaaattaaggatattcaaagatgggagagtatactgataaggcaatcgtgcacaggaatgggttactaatgcgattatggggaacatctctcttggggggagaaaaatgtgcctgtaatcagataatttttatttgccaaattaattacaaaatacctatgggctttagggaaaacattaaaaataaccttctctgtccccgaggcatcataatatcccagatcatatctgacgggagattaatttttccatgctattcaattttaagtcaaatcaaatacttaccatacacctaatgtgtacaaagcatggtatagcagatgacacactatgcaatgtattcaagtaaacatattagaatcctgtagtgtaaataatagcaaagatgctatcctttgctgaaaggtgaagaggcacttcagagagacaagctatttcaaagaaatgattttaaagaaatgtttcaaatatcaaaattattgagatgcatgtagatttatccaggcaaacatttctatgtgtttgtacgtgaatgctcatataacatttaatgccaccacaacagtttcattttctttaaaatggttttctggtccttagtaacagaagtctgtcacatatatctttggttctccattctgaaccaagtcaacttcatggactgtttatttcattatggtatttgctaccaccaaaagtatcctctatctttcttgttggggctttatataggacaatttagaaaggaagaggtgggcatgtgcacggtgactcaaatatatctgtttctatagggagataaaaaagattcacattgactcccacactgagatgcattttgtctaaaggtactggaactcattaactctatctactccctcctttgaccattatactagaatgtgccccagcaaaatgtcctcttccagggcaaattctcagattggggaaaagtcaactagctctatatagggttaaaataaataaaaagtccttgaatatttattttaaattgttacctcgagacatgacttttatacaaagttaaaaataaaatggcttctagtaaagacaatggtggttgtggtaaaggatctcaggaaacaaggacctcatagttctaaccctcttcttcatcctcctcactggacactcaaaagctacagcaggcaaataaagtccacactgggtgccacaggcaggaagttccacctgatacggccacgaccaccctccatgatctcacctgaaactgcctcccttcagctccttcttgcccacaagtcctttctggtgcctcccactcaacacctcctccctagggtcttcacatctgctattcccttagcctagaatgttttgtactcccacccttccccatctcatcagctccagtcatcctttatatcacagctaaaatgccattcctggccaggcacagtggctcatgcctataatcccagcactttgggaggccaaggcaggtggatcacctgaggtcaggagtttgagacctgcctggccaacatgccaaaaccccatctctactaaaaatacaaaaattagccaggcatggtggtgcatgcctgtaatcctagctactcaggaggatgaagtaggagaatcacttgaacctgggaggcagaagttgtagttagccgagatcatacctctatactccacctgggcaacagagagagactccttctcaaaaaataaaataaaatgaaatgtcattaccttagggaagccttcactgtatcctacacaggtaaggttcctagttatggccccattacatgttctgatagattcccaaacacctccttccaaaccatgtaacacaattgtaattcattgtttgtgtagctgtctatttaggaactatcatgctagacaattagctcttgaaaccaaagattaaatctgtcattgtcacttctgtatttatattaggacagtttctggcacatactgagatcctaataaatttatggaatgaatgaatgaataaactgaattgaagaactcaaaaattctcaaaccaagaaattttctcctttaattctttttcccaaatcaaacatgagccagctgactgaaagccaggattagcaaaccatcagctacactgccataagcctcagtgaagatcaaagaagcttcatagcacaaagctaagggagccatctcttgaccccctgatcacctggacactacttttatgtctcctacaaggcctgggataagctacagccaaaaaaaaaaaaggaattctcttttgctcccctgcaattttactccatccagtggcctctgacctggtctccagctcactgcctttgataagtagagaattttctctactagctaaaaggcataagggaggcattctcatgagatgaacttgcttgtccaaggtcagccaacatgcccatggcaaggtttcttatttaccaaagcagaagtgaaaactatcatgttgtgagaaagaaccttactgtaggcaaaataagcatgtttaactctaaattatccagaataaaactttaatgagaatctcaaactatggagatgaaattaattaattttcttgttgaaaattcaacataaactccaaatattattaatatttcaaataaaacttttagtgaaactgttttataggtaactccagtaacataaaagctactttacaactacaggatgatgaaatcactgcacaatatattcttagctaattctgacctgtctgactttttaactttctccaagctataaaaatcaatataatctagaatatataaagaactcttcatacaaatgaacaattaaaagacaaataatccaatttaaaaatgggcaaaagatctgaataagcatttctccaaggaagacatacaaagggccaataaccacataaaaagatgttcaacatcatcagctataagggaaatgcaaactaaaatcacaatgagataccacttaataccccctagtacggctataatcaaaaagtcagataatagcaggtgatggcaaggatgctgaaaaactagaacccttttacactgctggtggaaatgtaaaagggtgcagcccctttggaaaacagtctaatagtcctaaaaaggttaaacataaatttatatgacccagcaattccaaatctagtatattaacagcagcattattcatattagccaaaaagtggaaacaacacaaatgtccatcaactgataaatggatacacaaaatgtggtatatccatacaacggaatattatctggcaacaaaaggaataaagaacagatacatgctctaacatggatgaatcttaaaaacatcacactaagtaaaaaaaaaaaagttgcaaaaaaatttatattatatactcctatttatatgaaattaaataggagtgattgcctaggccagggggatctgggagaaatagagaatgactgctaatgggtgagtttcttttttaggtgataatatgtctcaaactaattatagtgatagttggttatctctttaattatactttaaaaatcactgaattgtacactgtaaatgattgaattccttgatatgtgaattacatttcataaagctattttaaaatttcagactctaagctgttaaaaccaaagtgccagggtctttaggtaccttatctccaatcttaaatactttaacattgtctttgaatttggtcttcgattgtaatgtagtttggaaatttgtccccatccaattctcatgttgaatttgtaaaccccaatgctggaggtggggtctgatggaaggtgtttggatccctcaaagcatggtgctgtcttcgcaatagtgagttcttgcaagatctggtcatttaaaagtgtgtggcacctcctccccattctctcactccattgctcctgctttcgccatgtgatgtgccccttttcctgttggccctctgcaatgattgaaagttccctgaggcttcaccagaatctgagcagatgccagcaccatgtttcctgtgaagcctgcagaaactcttttctttataaattacccagtctcaggtatttctttatagcaatgcaagaacggcctcagacaaaatgttaaaagggaaactggagtttcttgtggcttaagaaattatgcaattgaagactgctataccttgaatgagatgtccaggaaaacacttccaccagtgggttagtatctccctttttacgtgaacagacggttcaccagagaggaactccaagtggatgctaagctaaaaagcttgcaaaaaattaaagaaatgcaagttaaaatgaaattcaatctttttggcttacaatactgataaaaagaccaggattggaaaatttgtggttaatgagggaattcacatgcactgctccaggaaacagaaatttgtacaaccatttggaaggcaatttggcaatagctattaaaaattttcatgttcatatccttttacttagaaattctcttctaggagtttattcttcagacattcttgctcaattgggtatttgtaatactaaaaaactggaaacaaaccagatgtaataataaaagattggttaaataaaaatacagtttgtccactcaatagaatatctgatggttgttaaaataatgaatggagccaggcatggtggagtggcttggaaggctgaggcacaagaatcacttgagcccaggagttcaagttcagcctgggcaacaaagcaagattctgtctttaaaaacaaaaacaaacaaacaatgaggtggtttgacatgtgctcacatagaaaggtggccaagatgtattgttcaacaaaaaaggcaagttaggatttagtagtatgtgctcacaatgttaatacattcataggaaaaataccaaggaatgtattctcagtttaatgacatatcttagagtgatgggatttccattttctaaattacacatatctttcaagttttagggtttttttgttttgttttgtttttgtttttgtttttacaaacaatatgcattagtttcacaagcacagaaaggaaagattttttttcaaaggagaacggtcccttccctttgtgtggttcactgaagcatggggaggagggtggacaggagatagaaattacaactgtttccaataactaggaatagtggctgcttcctaccttccaccataaaaagtctctgccccacttttctcatctcccacagcccttcctttctctactctcaaacttaacgactccctacctcaagccactgaagagtaatcagttcccctgcctttaccctgttagggcacaagctcctagaagacaaaggactctgcctaggttatctccacagcccaaaggacaatgtctgtacacaatgttctagagagtttcagcagcatgtcggggcttttaagaaacagtttttgttttaaaagtttttaaatggtttttgttttaaaattcaaagagtacaaaaagatacagttaaaaaatgggccgggcacagtggcatgcacctgtagtcccagctacttgggaggctgaggcaagagaatcagttgagcccagtaggctaaggctgcagtgggccatgattgcaccactgcactccagcctgggcaacagagcacatatctgtcttaaaaaaaaaaaaaaaaagaagaagaagaattctcagttcccagtagcccatcaatgaccagtgtcttggctattctttcagacaggtctacacaaatgcatgcattcctgtggccccttttccttatgtaaattgtagcatgcactctgttctgtagcttgcttttttccacttacataatgatgcaactgtttcatattggtacatacaaacatagttaacaacaccttattattttcttaaatgctttccaatgttgcatcttatggatacaccataacttagccagtctcaccccacagatatcaagtttgtgtattatttaggataaggtccagctgtactcaagataacagcggcttaaacaaaattgtctttctctatcacaaaaatctgtggaaatagatagtacttttttacaatttgatattataaagttgctctggtactttacagtatcaaatgcccatgtcttgttactccgccatgcatggcctcattcccaagttcacccatggtcccagacagctgctccaactccctcccagtgtccacattccaggcagcagaagaaggggggacaaaagagaagacatgcctttccctttaactgtaattcccagaaggtgtatactacgcatacttacatcccattggccctatctgagttatatgggcatactttgtcacaaagaaggctgggaaatgtagtctttactccagacagctatgtgcccaccataaattgagtttatatatgttgctagagtatgtgggggaaaatagaattggaaataatacagtctctcataagttacttccaatgctgtgaaatttaatcaaagcaacaaagaacattcctatgtatctgcttttgtacacttatgtgagagtatttttggacaactttctacaagaggaatataagcagctttagaaaacctattccaattatttcattttacaaatgaggtttaagaccgaaaggggtaaagtaacttgccaaagtcaaacaatagctcccagaaaagtagggttgccagataaaatacagaacacccaacgatattagaatttcagataaacaacaaataatttttaatgtaagtatgtcacaggtaacatttgagacatacttatactagaaaagtatcccttgtttttctgaaattcaaatttactgagtatcatataaatgtgtgtatatatacatatatatgtcatatatacacatacatatacatatatatacatatatgtgtttgtgtatatatatagtttgtttgtttttttagagacaggctctcattctgttggccaggctgtagtgcagtagcggtatgatcatagttcactgtaactcctgtgctcaagcaatcccctcacctcagcctcctaaacagctaggactgcaggcatataccaccacactcgaataattttgtaatttatttgagacaggatcttgctatgctgcccaggctagccttgaactcttagcctcaggcaatcctcccatttcagcctcccaaagagctgggattataggcatgagccaccatgcatggctgcatcctgtatttttatttgctagatctgccaactttacagcagaaccaggtttagaacttaaatctgctgatgtttagtcccagttcttcctctgtacaagatggccatgtcaagtgggcacaggtaataaatgaggtggagccaacaaagcatactacaaatccccaggcaaacaaaataccttcctaccgcagggctcaaacatcatgctattcatgccatatgcttaatgaattgaatttttctgtcatagatacatgggtaacaaaccagccactctacagaggttacagtaaatgcttcaatccaaaaccattagagcctgcgtacttctattcaaaataacattagccttacattaatgcagactcacagaggctgaaagtaggcaagtccttccagagttctggcttattacacatgcagggaaggatgcaagcatggactatagatatgctaagcactcaaaacacctttgaaattcacagtcacttcatagtagttgataatgtcaatgtcggcatggggaaccaagctgaaaatctcaattacatcaataaattatttcattacattctctatatatagcttaaaaaattaaaacttcactaataaattagaaccttcccatatcccttcttcatgattataaatataccaagactagataaagagtactgcagaatgtttcatataacaagattttacaggtacattttacaacaaagaaatcaagaaccttagttctaagcacattttttattccaaataatgtatattatttccctaaaagagaactaccctgaagaaataactttccaaaatttagcacaaacctctcccatgaaaaaaaaaggaacttggtttttattcagcctctagattcaaccagaaatttccaggaaacacaaagaacagagtaacaatttaaactctctgcagggatgcaatcaacaaaatccaggctggagggaaactataggacaaacaatctggtctcttcaataactaaataacaaatggaaaaaagtaagtgagccttttaaaatattaaccaacacaatgtgtggtccttatttgaattctgatttaagcaaatttcaaaaaaaaaaaactatagcacttatgagacaactggaaattgaacactgcctgaatatttggtggtattaaagaaatattgctaattttccagggcatgtgataacagtattatatttagaacttttttaaaggtccttatcttttatagatagagactaaaacatttatggaggaactgataggatatctgaaatctgcttcaaaatattagatgaggagctggtagttggggtttggatggtgtagaagtgaccacaggttgatggattaaggaaaggtgatggttatgggggctgagggggtcacagaaatagaaacactattctgtttatatttctccatgtccaaaattttccataaaatttttctagtacatgccaaaaaattaaactaaaatctgagcagtatagttataaatatctgaaatatagtaatactatatcagaagaaaataatttaagcaatttcactatttcatatcctactgtgaacaatgcattaatccaaaaccctgtgtgctgaatatttttcagaaggaagggtctgacttgactgtaatgaattaaaaggaggaaaagtattacatgctaaggttacttcaagcacatttaattttcctacaaatctgcaatatcaagaccttttttctaaaaaccaattactattttccaccaataaactgtaaacaaaactctaatgaatgactttgctaatacctgtttttactatgttcattactctgtggcccagattttagtctgatacgtaagtggaacatcaatcaaatatcaaaagagaagaaaaatttagtctgacgtatgctaagaaatctatgttccaaacttctttttaaaaagggatgccaatgagagaaaccccaacacccatactgtgaaacaatttgtatcagctttattaaccacgatcttgcaaaaaaagctactttattcttgtaacaccctctctggtttgttttttcccactagcaattgcatgaaaagggaaaagcaggaaagtcccaagactgtacaatctaaacaatgcctagggaaacagtctgtgaacttttctagctctacttgaacctatgtatcacaaaagctcgaataattttcaattaggccagtgctaccactacctggaggtataaaatgcatactgcctttttaccaataaacattgtttggtctaggcatcttgtgaagtaagtagactacacaggagttagttactcttactttacaaattaatcaactgagattctgaattaacagatttttcaagaaagagtaaaagagtggttgacttaaacccaaattccctaaaaactagtcccaatattaatccatctccccacatgtaaacatatggtcatgtataaatctttttgtatgtaaattatgctctgtaacccaatcaatatttatttctatcatcaacatccttccatacatcaaagcctactttatcatgcagatagctgcagaatattccacagcagaaatgtgccaatctttgaagttgcatagtttcattccaaatttcaatgatgttatcataaatttgcaggtatatatatctacatgaatctgtaccatttattctgcagaatttattctccagaataaattcttagaagtagaatagctgctgggcaaaggtgatgcaaaactggagcttagcccaggagggttcttgccttcacccaggaaagatttcaagggcaacctagtggtgttagactgcaacttttattgaagcagcagtgtacagcagcagcagaagcagggccaccccataggcagtgtatttttctgttctcacactgctaatacatacatacccgagactgggtaatttataaaggaaagaggtttaattgacccacagttccacatggctgggaagcctcacaatcatggcagaaggcaaaggggaagcaagacatgtcttacatggcagcaagcaagagagcttgtgcaggggaactcccatttataaaaccatcagatctcataagacttattcactaattcactaccacaagaacagtataggggaaccacccccatgattcaattatcttcacctggaccagcccttgatacgtagggattattaaaattcaaggtgagatttgggtggggacagagccaaaccatatcaggcagtgtgcccagagtggcagctcaggggcagttctgcagctatatttataatgcacttttaattacatgcaaattaaggggcagattatgcagaaatttctagaaaatgggtagtaacttctaggtcttcaggtcattgccatggaaaggagtggtaacctccctttgttgccatggtaatggaaaactgacatggcacagatgggcatgtcttatggagagatgctttcatctcttccctgtttcagctagtcttctatctggtcctgagttcaaatccccatctccaaagtcaagtcccgcctcctatctcaaagggtgtgtgcacttaagtattgattataacagcaacctgccccctaggagggctagtgcaacttacaaccccactaacagtgattagggtccatctcacttctcctcccaccactgtgtattaagctttgcatatgatagctgaaacttcggcaatatgatagctaaatataatctcattgttttaacctacacatattttattagcagtaaggttgagcatcattccctaaattttgtttggttggttgtattttttttctgggaattgtctatgcttgttttcactaatttttctactctatttttaatcttttattattgatttataaaagctctgtataagttaaggcagggttcctctacctcagcactattgacattttgggctggataattctttgttgcaagggactcttctcagcactgtgggatatttagcagcatccctggcctcgacccgttaaatgccagtggcgctcctcccaactgtggtaaccaaaaatgtctccagacattgccacttgtccttggggaagcaaaactgtccctagctaagaaccactgtgttaagtagattaaccctccgttccaattacatgctacctcctcttggatccacctccccactcagtagaagtgcccttcttctgtattccttatagatggtcattgacttaaatactattctaattttctagatgccttctcagtaccaaacagctataactgtttcaaaactcatacaatgaaagtgaagtctaaactcttttaagttccaatagtttcagttgtatcctctagaattgcattgtccaatacagtagacactagccacatgtaactatttaaatttaaatgaaattaaataaaatcaaaaacttggtttatcagtcacactagacacctttccagtgctcaatagccagaagcggcaggtggttaccacatgggacaatgcagatatagaatattcccatccctgcagtgttccattggacagagctcctctggagccttgccactcacagtgtggtccacggaccggcagtatcggcatcatctaaaaacttcttagaaataaagaatcccaggcctcaacagacctattaaatccgaatctttattttaacgagatccccaggtaattagtgtgcatcctaaagtttgagaagcacagtaccgaaagacccaaacatctgaggtcacttatcaaatgttcactcattctagaagtccatatttctccagactaaacatcctcagcctgtcatcatatgatctggattccaaatccccatcaacccaattcttcactgttctctatcatcttccagtctataaaaggacagaagggaaggctgtgcttcaggaaaggtctgaaagtgagaccatcactttctttaagctggataccatgctgctttcaatacagcctcagtgtgcattagttttgtctacatttgataatttcccatcggccacatcgcaccagaggtgcataataaacttgtgatcagcaggttccttgggccttcttcatggaacttcatggtcacaagtaccacagacttttgcacccaatgactgggggtctttaagttttacaatgttctcaaatatattccatgtaaatgactgaatcacgtaaacagtgaagaaaagtattagacctatgacaacatctgtaagattctctcttgttttgtaaatcaattaatattatttttattcttctaaattaattctaatgatattaaatttttgcagtcattcttatccttttctcattttgctttatcttttctgtctcatccctagaaattccctattcgtattgccctcatcatgcatattaattattcagtgtggataaatgtacaaatgcactaggaaaatatatgtcgaatgactcctacaaaaaaggcaacttgggtaaatcgaagatatgcagggcattagtgggtacaaaaaatagaaaaaaatgaataagacccagtatatgataacacaacagggtgattatagtcaataataattgtacattttaaaatagctaagagtataattagattgtaacacaaaggataaatacttgagggaatgaataccccattttacacgtgattattatgcattgcatgcctgtagcaaaacatgccatgtatcccataaacatatacacctactatgtacccataaaaattttttttaatttaaaaaaaaaaagatatgcaagacaagatctcctttttaagggtctaataatccagtggaaaaaagaagttttcacacaaataattataacaacaatatacagcacgtgctatataagtgatacaatcaacatgctgtaaaaaattcagatgaagaagcacccaatttctggctgggataattagaaggggaaaaaacttctcagaggaagtagcatttgtactggtttgatggatggataggacttcaacatgtgggtgggaaggtttgggagaatagtcctggcagaccaagcgaacgtacaagcaagggagatgcaaatacaaataggttgactttggccaaagtaaaggatgtgtggggagaaactaggcagaaagggccaaagcacaaaggttggatacatttgatgatgaaaagaaaaaagaatggatggaggccaggcacgttggctcatgcctgtaatcccagcaccttgggaggctgagacaggcagatcacttgaggtcaggagtttgagaccagcctggtcaacatagtgcaaccttatctctactaaaaatacaaaaattagccgggcatggcggtgggtgcctataatcccagctactcgggaggcttgagcctgggaggcagaggttgcggtgagccaaaattgtgccactgcattccagcctgagtgacagagcaagaatccatctcaaaaaaggaaaaaaaaaaagaagggatggacccagactgggcagtagccctgatcaaagtcaatgttcacacagtatctaagcctgtctattattagggttgactgaaaggaaaggaaaagaatcaatgaatgttcattcataatatataccataagacacatagatacatagcatagatagatggatagatggatggagatagatagatacatagacagatagatagatagacagatagatagatagatgaagaaatagattaaatgtgttttaaatttaaatgtctggatgctatctcataatatgataatacagatctcctccactattggatatttaggttagttcccatcttttatcaatatttaacatagaacaattgtgatgaacatccttttactctgtgaacatgtaattgctagaagaggaactgggtcaaaggatatgaacttttttttctttttttttttttttttttttttgagatagagtctcactctgtcacccaggctggagtacagtggcacaatctcggctcactgcaacctccacctcccaggttcaagcgagtctcgtgtctcagccaccctagtggctgagactacaagcgcgtgccaccatgctcagctaatttttgtattttcagtagagacgtggttgtgccatgtcggccaggcttgtcgtgaactcctggcctcaagtgatctgcccacatcagcttcccaaagtactgggattacaggcgtaagccactatgcccagccacgatatgaacatttttaagacttttgatatacatttgccaatttcattccgggtagtaagtacccatttatacctccaacatcagtatgtgggtttgtttatcctacgtggctgtgtccatctcaccgaaagaaggtgggattctgaacactatacctccttctccagtggtgtgaggagtcagaccagagtagggaggggctacagtccccagggatgtacacaaaggggtcgaggtagaataaatttcacccccttgttgtaattgtggtgactcctcacactcattaggctggcttcatgggcatggcctgtggagcacacagggcccagacttagaagagctctgtgtttgctttaataaggctctgctatcaccatcttgtaattcctaataatttttgaacaagggccctgtattttcattttacactgagtcttgcaaataatgtagccagtcctgctcacaccctacagtgcctaggagagcatgatgcacataagagacattcaaaactttctctaacttgaacagtattattgtgtttataggaaagagagagggaaaaaaatcaaactcaatctcaataaatgcaaaaactcttaattttgttatacagaccaagagaaaagttagattaattagaagtcagaaagttgcagaggaggcatggaaagaacaaactaaaaaaagttttaaaaatccagacagacaataattcagaaaaacactaagttcaaagtcaatgagaatcaggcttttctatatcatcttcccagtggattcttgaacttaataaatgtaatttctgcttggaaattttcctggaggccatctggaaaattaagacagacaggataagtgtctttttattattctgagccacataaaacaactcgtctcaagagctggtaaagactattccagaggaacccaaaccgctaatctcgctactcccaacaactttcacccacccccaaatttaatagactattagtattcctattgtgaacactgtcctttttccaagttttatttaaagcttagaagatcaaaaagtattagaattctgcagatggattcacaggagggaggccccagacttcatcaggtcagaagcattctgaggtttaagtccaagtccacttccttctcacgtcctctctaatttccattctgacattcttgagaacatgctcttaagtctggtctcaatcaaccacttcagaaccacagagggtatttcttatgaatgctgatttctagaccccacactggaccttctgcatcagcatttctgggacaagaatcagaaacctattcttttgaccaactttgggtgagtctatccacaaaccagaacttctcacacttattgtacacacacacatcacctggggatgttgtgaaaatgcaggtctgattcactaagtctaggtggaggggtgagagtctgcatttctaacaagccaagagcagtaatttccaccctgactgcacattagagtcacatggggagcttgtaaaaatcctgatgcccagaacaggtcctagcaattgaatcagaatctctgatgatgggcccagggacccccctggaacacgacagcaggtagatacaccctaaacctgtttccctgtactcccatcatactgcccgtcacttcagatgcacacactattcccccaccaccagctactcccttggccttgctaagtcctactctgtcttcatgctgcagctcaaatgtcacctccacagggaagccttctcaaccagtgtccctagcacaaagccaaaggaggtccctgcatgtatatggcttatagcaccttgaacatccttcaaagcgtcacacattttataatgatgtatttttgtgtcagtgaagaaataatgtccacctcaccccaccagcccttgtgagactcgggataccttcagtcagaggatagccctcaactcagcactgtaaccccagcagcttcccagcacttcataatagtaaagacaaacgtgtggagttgccttcctccgtgctgggctcttctctcagcactttacaaagtaatcctcacataatcctgaggtaggcacaattgttatccctattttatggatgagaaactgaagcacagacagttgcttgcccaaggacacagagctgaaggttgccagtggaggaagcaggatttgaacccaagcaatctgggttaagtaagggagataggcataatgtgggactacagagattccctggggactccctcccccaaacacacacacacacaccccatatacgctcacatcccccttccctgacacacacaattacgcttcgtaatggtcacaatgcctggagagccatcactcatccattcaaaataaatgtactgaacagtccctggtataagagggacattctagaaatatatgagtaatagatatttacttatctattattagacagacaacagacgaataagcaaagacattgcaataagtgtggcgaaagaactaaacgaggtggtaaggtaagggctggcaggctccttcagacagcgtcaggagagaagggctccccgagtgggtgccatctggctaaagcctgagagggcagtaagcccgctgtcccccaggagcagcagcaacgcaggcagggcagttgcaaaggccctaaggcacagctctgcacgcgcgcctgaggaacgcacgaggctggcgtggccaggagttgggagtggtcaagacaaagcaggtgtgacgggcaaggatcaaatcacatctccatatccaggatctcttctacccatgttgtcatcaatccagtgaccaaaacacctaccagtcatctcacacacgctcctgtgttcctggaggcctgcggctcccgtgaggcaccatgcctgctcgctcactgggccagaggcggcacgtgacctcaaagtagcccatcctcccggcaacctagggcttcgcattgtatcaacactctgctcagagtgtatgcgtgtatgcatgtgtccaggctcaccaaattgtatgcattaattatgtgcagggttttgtttttgtttgtttgttttatatttaaaaaaatataatcaaactaattgccagccaagtcagtcatcctcctgggaatatatagagtcccaaggttagcgttcctgtattagactatttcaattttaggaaaatcatgactgtgtggggaaacaatgactttaaaatgctaaaattaaaatttatgctttaactgggaaaaaaaccattgcattgtttgtttgcataccaattataccaaactaaagctagacagaaaaaaaaaaaaaaaaaacctctgctcacaaagggctggtgatatttaaatgaactgatcagattctctcaggaattttaccagaaatataagaataaggcagttggagatagggagaaaagtagacagggagagaaaaaatcatagctaggatattttaataactgactcttgaataaagatctaaaactcttaccactacagcccctagtgaccccgtgtatcttcaactccctgacccccagctataccttggttcctattatcagatttctagaagattccagccctcttaataccatttgtgtaataatggcatctgttgaacacgtactctgtgctctgtgctgtgggctttccacgctatctcatgtagtcttcactagaaagtgctgaggcaagaatcactatccccatttttacagctgaagaagcatctctaagaagttggcttacccatagtcataagctgttgtgggcagacctgagactgcaaaagtctgtgctgttcctattttcttaaaatgaagcctcattaccccagttggcctgggtgaggcttttttccttataacctgaaacagagttatctttttcagtgtctaagtattagtgccagtaattaaaaagcgatggctttcttaaaaattatatgcaaagctgtatccaaaatgtcaaattttgggatatatatagagagcaaactgatcttaatttatgtccctgtgatataaaacataaatttagtaagtgaactttggtgaaagatttaaacacaagcaataaagcatgtattcattaaatgtaccacacaatatgatacataaatatcaagccatatgaataaattaacaaaattactctatagagagctcttcccacagcacgatattcctgtaataataactaacatttactgagcacttactatgtgccaaatgacgtgctaagcactctgcttatagtatgtcatttaaacctcaccatgggagaaacagtaaaataacgccagtttacagatgtggaaacagaaactcgaaaagaccaaatagctggttagtgatgtcaagaattttgagttttctgggggggttgtttttagaggcagttttttgtttgtctgtctgctttggttttggtgtttgtttggttttgagatagggtctccctctgtcacccaggctggagtgcagtgatgccatcatggctcactgcagtagaggcaagttttaaacacaggtatgtctgcctctagaggccttgctcttaactactccaagtatcttgattacagcagatatcatactatgttgtgatagattatctgaaagtctgtcttccactatgttcccaatttcaaagtatttacatcctctccttttcacttgtccctccttgcccaggatacagtaggaatatgatatttatatgaatcaactagctgatctattagtaacacaagacttagaccaataatcattcctgttgaatcaagactattgggtgaattttgcaaggtgatgaattatctcagaaaaaaaaaaaaaaaacagaatccagaaagcttaacctcaatttagttacaaaactcaaactacaatcaattcccaagcagaagactgttgagtttttaccttcttattaacagattgatttgtgacaattctgtgccactcagaggaaagagaaaaaaaactgagatctctgaaaatctctcataaaaattatctgtaaataacaagaaagatgtcgaaatattaacgcctcctccatgagcacatcaaaatgctccctctgccaccttccatctgcttgcctgcctcacccaacgtgagcacagccccactctgctttcagcttctcttggatgtctaaaaagactgggccaaaaattgtttcagcacgccggaaagtataatcctcacatttcagacacatttagataccctaatttaaaatatggtggaaaatagcatacttgcaggctgttccttgctatagtttaaatgcatccctcacaaaattcattcctctgttaaagtcatatgcataaacttcacttctaaatggaagtaacaacaacaatagcagctaacacttacatagcattgttctcagcactctatatacagtgattcatttaatcaccttatgacactactctttttagcaccattttatagggtagaaaactgaggcccagaagggtttggtgacttttccaaagtcacagggctggtgagtagcagagccaggacttgaaaccagagctatgaactccagatactatattcttaaccactgcaccaaactgcccagggggcttcagccactaactagcttaatcctttcttctccaagatccctggttgtcatactgcaacagaaaaaaagctggagggtgagtgtggttgattgaatactggccccaaaaagcatatgtccaaggcctaactccctgaacctttgaatgtgaccttatttttaaaaagagtcattgcagatataatcgaagttaaagatctcaggatgagatcaccctggatttaggacaagccctaagtccagtgatgggtgtccttataggagaaaggtagagggagatttgacacactgatacacacaaaggagaaggtgatgtgaagacagaggcagagactacaatgctgcgtcaacaagccaagggctgctggcagccaccaaaaggagagaggtatggaatgtattctccctcagagccttcagaaggaaccaaccatgccaacaccttgatttcagacttctggcctccacaaactgtgagagaagaaatttctattgtttcaagccaccaagttagtggtagtttgttatggcaatgctatgaaactaatataatgagtcatggatcaaaatccttcagcagaaatccacatccccactctacagatcaggaaactgaggctcagagtgaggacttcattggcacgctgtcaagcacacaaggggtttgtggcagagccaagccaggctctaggctacatactgggtcttcggacatctggactagccccttcttcagtatctcatatctaccactttgagagacataatcatgcagtgttcacagacgggcactttagagtccaaccacctgggttggcttccatgtttggcacgatttgtgagctgtatacctcaaatttctcatctgtaaaacaggaacaaaaatgacacctacatcacagtgtcattataaggagcaagtaagtcaatacatgtgcctggtatgcagtaagctctcaataaatgttagctattactattattttattctaatatctacttaattatagataaaggttaaactataaagtcaggaatatggcagtgcctagaaaaaaatggatagacatattaacaggatttatctttacgggtgcacatttgtgacaaatgctattaactaatttcttatgtgggggttggacatcaagaggtaatatctatcaccctcaacttacacctcttagccagtccttactggccctgatggaaaaaggagtgcctaatatgactagccagagaccaggacattgactaggacatgctgtgctggtggacagggtcactgtagtgcaaaaggcccacagctgtgcccctcactccaagctgcggacccgaacaaggcaagccagccccaagcctcccactttcatgctctggcatggtgaccactcctggaaacactgcttccccaggcagcactgccatccacccagttttccagcctctcaggacagggccttgccaagtcacctttattctttcacttctgggcatccatgtggtaagcacactacagcctcctctcttgctaacctgatctccccctgagcatggtggctgcttggggtcagcgcacagcaggtatggccatcttgggtcctgggaatggagggagtagcaagcttccttacctaatcaaaaaatccctgcatggaaggacactgagcccatcctcagaattaataaactcatcctccgtcttccatttgactactggtctctaagtgcatagtccccttggtcagacactggggagaggaaaaagaacagtggcattcagacaccaaaaccccacccaaactcctaacaaatttatattaccttctgatggaaaatgtgtatgataagctatattttttcaaagaataatgctcattgcacagtgccttctgacttattgaatttcctaacactcttctgaatgatattgcaggtttgaagaataacaagaacatgaaacacctcgggaaatttctcccccaaaccaaataaccaccaatctgttgttgttgttactccgctttaataatagcactgggcctatgcacacatgtgcacccatagaaaccacagcccttgtctgatcacttctaccccaatataaaaatccaaggtagttgctggaatgaagataaatactactggaattaacagtgtccttaggaaaggcagggttgggatgctgatttcatcacaattctgcctgtactttttcaaggaagttcaagaaccatgggcagctgtagaaatccaagtcatcagaaaagcaaacaaaggcagctcctcccccgcaaagcatgttccctggaagggcctctgcatctgccttcttagcataaagtagtggtggcaccttaatctactgggaacttttctgcctttccttttgttccactcgaggccaggcaccagactttcatcattatccataatcatgtcaactctctgacttttgagaattaaccaatgcctgctacaccttactcttttctccttccctagatatccaaaacaaggccctttcccattttctggttctgtgggggtagctcttaaattccttgaagtcaagagaattattaagatgtcccttctggttgggcacggtggctcacacctgtaatccccgcactttgggaggccgaggtaggtggatcacgaggtcaggagatcgagaccatcctggctaacatggtgaattatttagactctactaaaaatacaaaaaaattagccgggtgtagtggcacgtgcctgtagtcccaggtacttgggaggctgaggcagaagaattgcttgaacctgggtggcggaggttgcagtgagctgagatcatgccactacgctccacccagggcgacagagcgagactctgtctcaaaaaaaaaaaaaagaaaagaaaaggaaaagaaaaagatgtcccttccactctctctctctccctctctgtctctccccccaggtacagagttttcactcaggactctgtgagaccaaacaacatccatattttaccaacatttcgaatttaaaaatgttcttcatttcacctttaaactaaaaatgtacatctgtcaaccaaggggtggaccagaggaacacggagagacaatgtcctacgtaaggtaagcagcaatgcttagctccagctcactgggctcagggctaccacatctttctggtattcagggaaatgaagaaatgcaggtttttacatgaagtcctccagttttcaatcttaacaactaattccccaggtcacacagccaacttgtagcagagccagaattggacctaggcatcctggcctcatgagctcaagaggccttagctctgtatatatttgtacctttcattcaacaactgtatactaaaaaactgctatattcaggaatgttattttaatgagtggatggatggatggatagatagacagatgggtacacaccctaatatttattaaggaatgaagggagaaagtaaaatataatttccaaatttacaaaatattttttaaaaactgagacaaaacattaactctataactatcatttttcttcctaaaataattttatttgtaattgactctgaatagggaatagatcacacagtccgaatgctgaaagtaagggaaatatagaaattgtatttaagccagggcatctgccatttaagaaagccatgagtaaggaagcactgtagctttggaatccacaggtaaaaccttttcttggattatttaagaacaacctcttttcccctctgcactcttgggaggatagggtatatttctgtagcatttctatagggatggtaattagtatagctgagaaatgccatcaacagcaaaagtaaaattagcctttacttgtaaaattttctcctggggaaatgctggtagctcctgtctccaccaagcatggtaatgggcttgctgtgtcatcccattgcaagcaaatcaccccatcagcagcgcttgaatagaaccaccagcacaacaaataggacagccaacacaaatacttttgcctgcttcaactacatctgcctcaccctggccccatgccctcatcaaatcgcactcatgagtcataacagcattgactttcttttgtcaccaaagcactcttaattttcctgaaaatttttgagtggcttggagccatgacacgttttaaccaagttgagccttggaaacaattgtattcagtatgatgatgcagcaggggaaactgaggtccagggaaaagacgtgatttggccaacatcacatctaatttggcatcaaagccaagtctaacttaattcctagtaggggctttctctttttgatgtaccaagcagtctttttaggttaaaatttacttctactccacacctactaatgtctctttatctggaccttctctgaccacctcctcctgaggtttgaagaatagaaatctcacctcctgcccaaagctgatctgtctccctactcttccaggcttggttccatgaaaaacccctcttcatactggcccattccctacaagttaaaaatatggtcaactatgtcacacaaagaaggcagggagagattccccaaactatgcatcttgttcagttaccacccttcaaagctaacctccttgtgagaagagtataaaaagcaacattaacacttccaagccactgcagccccaaatccaccctaaccatgccatgatgatgttctggcagagaccacaagaacgcaaattccaccaaacccacctccctactcaacaacaccacttggataaatgacgctttgccaacaacaaaacatgattaaaaaaaaaaaaaaaaaaaaaactcctgatctctctctctaaactgaaactgttttacccttggtcttccccagtggctcaagactccttttagtacacccacaagaatgaaagctccatacaggcaggaagtttttttctattactctaacctctgcacctagctcagcacatggttccatgtttattgacttaatccatttcagtcattcagtcatcatattgtttgaccttctggggtggcaccagtgaccttgccagtagaaagtaggtagacatatctaaaggccggtgcagagatctaagttagagaacttgactggggggatcatttctttggtacaaactattgaagtgtcattataagagtcttagctggccagatattatgcagcagatggattctgtagactgagatgagcaaaataggccaaagtttataaaaaccaatcaatcaaacatctcctctgagtcctatgtttctagctggttggattaatatatatagcttgctagatctggaaaccatgtgatctttctttgggcaacataagcgtctgccttttctgaggattcagataatagtgtttactgggaaatcaccctcatctttttttctattactccctacaatgatagtgaatttatcgtttccatctcatgccgtgggacatatttcaatgtagcataccagaaaaatgtaatgtgagtctttcctttttttttattttttgcacaagaaaagcctagctgtggctcagaattgtccagggcagccatctgaaaattaacacaaactggcttggatccagttatgggagtcaatacctatgtcaagaaaactctcctagccattcctaagcagctcatctgaacttggtttcaagagtagggtattctaattccactgactctataaagggtaaagaacaataggataacttaaactattaccacatctattttacaggtaaggaaacaagtgcagagagataaagttaaccaaattctcacagctagaaaggaacctaggtaatccatctccaaagctggtgctctcgaccaccatcatagaaaacaaagcaggaacccagaggcaggctccactaacaccatgttgccagttctgctcacagaaactctttgaacaggcagcatatcagatgcaaaggcaaaaactagggctactaggattacaatgtaagcatcatgtagtaatgtcactacatgtcctacaatgagggtaggaaacatctgataagtgttaagtagggttcaagattagcaccaagttgagactatcccatttaggttcatcagaagtactgaaataagatttggaaaggggccggggcagtggctcatgtctgtaatcccagtcctttggaaggccaaggcaggaggatcatttgaggccaggagttcaagaccagcctggccaacatagcgagaccctgtctctacaaaaaaaaattgtttaataaaaatattaggtgagcatgttggtacatgcctgtagtcctggctactcaggaggatgaggaaggaggattgcttgagccctggagatcaaggatgcagtaagctatgattgccactgcaccccagcctgggtgatggagcgagatcctgtctcaaaaaaaaaaaaaaaaaaaggattcggaaaggggatgacttccttttacatgggcttcaaagttgtttaattcagagtcctcacctgtcctaagatcctcttgtgtacacagagctactcactccatactacagtcaatcctgacactggagactgactttggagttagtctgcctgggttcaaccctagctttgccacttgctaaatgtaactttttgacaagtgacctctcctctgaggcttgctttgctcacataaaaataaatacatataataataacagtacctacttcatagggtcattatgtggattaaatgagataccatatatgtggcctttggctttatttcatttagggaagtactttacaaaccacactgattgtttattattcttacttaccaggggaacatattgtagttaggtgggtacactaaatgggaaagtgaagtgattcacagactttacatgctggcctgagaaaggcaggggctcaggccttccccaactcccccatcccaaacacttccagaagccctacactggctggatgttaggaggatactgtgcccactcttagactctggctaggcttctacagaagacagagagaggtcacatcaatggctcttccagaaaggtaaataaactaggcaagaagctttcttccctagaccaaacttcatgctcaggtcaagttccaaggtagagtcaactacccataaccaacaagatatatcactgcttcattccttattcacagtctacatagaaaaaggaaatgaacctctaaggattttcacaagatggtaatgggacagaaagtgcactttacacttctttagtgtcttcttcagcccttggcatataactgggaacatgataggtacgtaattaaccctcacttgataattcaacaaaatcattcgttccttgctcttatcacaaatgcctacagcataactgcatttgtagtatgagatttgagttacaattacaaataagtgatatagaattgccagaggtaaacttggaattttcgtacccagagacaagcataatgaatggaaagtccttaatgaaaatatttaaagatgtgcttttactatgtgacacctaatgctatgcaaactctttcaaggtaacttattcctgaaggtagactaaaatccaccacctccagtatattgtatctgaatacacttagtgaatgcagtacagtccatcagcaagtttccatcttaccaatgtacataccctttatcaccaaaatcctggcacatgccccctatttctcagcacaaactgaatagcagtgaaatgaagacatgtctcatattaccaaaagctcattcatttcactaatcactgggaactatttactcccaacacatgtgcaatattttatgaagtggtaatatctagacagaggatcttgatctaaatatcctgagatgcccttcgagtttgcagtagggatgaggaagtgaaatttgtgcacaatccagattatgcacacctttctagggaaaattatgacattttcatcagctctcaaagtgtacatggcttcccaaaggtaaaaaccccgaagagaaatttaaaatttttgagaaggcaattttatttattatttggtacatttctaaatttaagcaagttctaaatctggccatcatgtgcactgtccaactctccatctcataggcttattgatttctattggtcttaggattccttggaaacttttatattatttcacatggatattttagaaagattttccaagggatgaatcggtgagttttaatttctttccattccttctcagataatatgtactcacgagccaatcgtttttagaacttaagtggttatacttttttttttttttttttttttttggagacagagtattactctgtcactcaggctggagtgcagtagaatgaacacagctcactgcaggcatgacctcctaggttcaagtgatcctcccacctcagcctcacaagtagctgggaccacaggcacacaccaccatacctggctaattttttagtaaagacaggatcttgccatgttgcccaggctggtctcaaattcctgggctcaagtgatcctcccacttctgtctcacaaagtgctaggattacaggcataagccaccatgcctggcccaattatacttacaacgaaaaccatcaaattattacttacttctaaaagtttacagatcctaattagtatcattttcccatccactttggagaccaaagtctccaatgaaactaagggaatttgggggccgggtgtggtggctcactcctgtaatcccagcactttgggaggccaagacaggcagatcacgaggtcaggagatcgagaccaacctggctaacacggtgaaaccccgtctctactaaaaatacaaaaaaaaaaaaaaattatctgggtgtggtggtgggtgcctgtagtcctggctactcgggaggctgatgcaggaggagaatggcatgaacccaggaggcagagtttgcagtgagctgagatcgccccaccgcactccagcctgggcgacagagcaagactccgtctcaaaaaaaaaaaaagaaagaaagaaagaaagaaactaagggattttatagaaagtggagactgttttaattccatcaaggatgcactctgatagtatataaaagcgccatgtgggtccactatggtaaaataacatgaattgatcctggtgttggtcaatataacttccagaatttctctagggggcacaatgtaggtagggagtgaagaggtgagtgtggaggttagagattccaggaggctactgaagttgttattgaaatggctagttatagacagaagttaactagttatagacagaggttaacagaagctaactattcagactataaaagtcttctggattcgtcttggtcctcctaatactagaactaaggcaagcttctaactatgtgttgcacaagcatatttcccagcaatggctgtcctttcctcctcaccaccttacccacacactcccttgctagagaatctactcatcatgcccctttctcagaaagaccttttccatagctctgctgagggggcgtggatgtgtgactcattcccttggccacagctgactggacctagaagagactagacccaagctaggtcaattggattattggttctctgaatttgaagtcgcaacagcgcaactctaggctgtccctggtgagcacttgaatgaagaagatacacatgctttccttgagtgccgctttttcataagagatatataaaaatagatattaagagagaaaataagagtgatagagatgtgtatgtgtgtataggagagacagagcagagacagagatggagactggctttgttgatattcctcatcatcttccaactgaccccgattcccgctccatgtgacacctggctgccctacttacccttaatgtctagtaggtatcattatgtgctcccagtaaatccctcctccccactttttttttcttaaacttgaatgggtttctgctacttgcaaccatattctcccttaaatgagggagagtggataacttagtaaataaatggtctggattctcaaaaagaacaaaaaagatatttcacaggggaaagttgctggcagaggcagaaatcaggaaggctgggacccaagagaggaagatctgattttgagacacaagatgtggaacaaaagacaaagcctgcatagtgtatcaccccagtgaggtcagaaaccaactgaggaggaagctgagaggtgcctgttgaaggccccctggactaggaggccagcgaggtactctgaaattcctgaagatagaggcaaggacaggaggaattctaaatgattaatgagaccatcctcattgaagtccaataacccaaagtaaagagctgccctgtccctgaaactctgctcttgtagattcagggaatttgtcaaagtcacaaccacctgaaagggtctgccaggcctttaatgagcatcctgagagataatctccctcattcctttgccacctgtggttttaattttccagccagtcctggagttgcttcctcccatccttctggatgggtttccaagacaggagtgttcctttggcattctcctctgctcatttacttgacaagaatgtgtttgctacctcctgctggccctccctcctcgcctgttccttgcttccttcttcgttcttgctctctgtcctttctgtatacctctttgacagcatgctgaagatgctgtcaggcaacacattgcttactccactctatcttagagcttccatttcagccccagattccttggttttcaagcaagtttgatgtttttcccttcaagacagtggaaagagcacaattttagagctaagcatacctgagatcaaatcgcagctctattggtgaggcctcaggcaagtcactcaatttctctgtgacctgtttctcttgcataaaatagagatgccatgtgtcttgcagggctgttgagctcacacatggaaagaaactagcaaattcttggcacatagaaggtgctcaaaaatgcttacttcccctccccttttgtcagacatggacgaaaaccaccataaagtcagtgaaagtgtaaagaaattatagttttataaaataggtttatttcctttatgagttgtccatttccttacaagattgacacctatttaccaaatgtctacttctaaaagaattcaagatatttgaagattcatgattaccaatccataattggaagaatacatttttaaaaagacatcattgacaattcattctttcccacacaatgatgaatcatgttttagtttttatatcatcatttttacaaaaatacatgcattttgatcatcagttcacaaagtgaaagtaaagcactgagtgaaggcaaagcatgatatgcaaaatgaagttatagtaatcatctagttaactcagtttctcaaccttgtatctactggcattctgagctagacaacgtcaggggctgtcccgtgcactgtagcatgtttagcagcacccctgctctctactcactaaatgccagtagctaccatcccccaagttgtaacagtcaaaaatgtcttcagacactgccaaatgtcccctggagaaaaaactgcccacagttgagaactaccaagttaactttatcaacgtatggagacaaacgagacagctcacgcccagccatgggtttgtaagatgaaaagtagctgcctcagtctttacttctcaccagatctttcctactgaaaaacaaaatggctacacgttgcttccaaggcacaatcaagcactggcttcacagagaaacagaagaaattgcacgtgccagaattcggttgttagactgccccagctcttggctgcactcccacgctctacctaaaaacctacttcccaaacttttgaaatgctttccacagctttcagaacctgacctttacaacagctttatctgtgtgtctgtgaaatagatttacaattttctatgttcctgcgaggccaaaccacttattgagtccaaatgccaactgggggtggtgggaatttgcacacagatgtcaatggactccgaaacaacaacacaagagctccacctgcaactaattatagaaactgaaattgtgttctggccagaataggccacattcagaacccaccccatctgctttggcctgtaaaatcactctgttacttttctgctgtcaacatagacttgactcttaaaattctctgaggatgctgtcgatagcgaacaacagtgaatattttgggggtgaatgttttgggagtgaccactcctcctgcctttccctcttggagcttggtttcaataagtacccttggcgcaagtgagactaaaataatctattcattgaaataccctgattttttttttttggtggcttatgtgctgctgcaatcccgtcacccaaataaagtgatccagagagaaaaatggaagatggaaatcatttaggtctcccaaggtccagcacacaagaatgtttatttccctaccattagccaagtctttcagaagaaaacctgggaataaaaatctgtaaggccactaatgtggtacacatggctgattctagggccgactgcaagagattactgaggccaaaaccagctgacatctgtgacaaagatgtatagttcacttcaaatcattatcctaccttctagcaaacaaagaaaccagctcttggctctgtgccatctcatctatcttcaaaaccaaaagaagttttcactcatctctgaaaggcatttaaaattgtagtttccatctaagtaggtcatcatctaagtctggaccaaaatttttccagctctctggaaaagtagacaaaagctacagttctctgaagagctaaggaagactgtttcaagatgagaagatggactcatttttttgtccttctgagattcagcattccaaggtatgttgtggtgctaaactatattatccagttctaaatacgtgtgtttatgtaacattggggaaaacacacacaagcactcacacttcaactcggaattaaaatgaaacaccttacacacagacgcaacatatgattgacttcttaagttctcaggccccactatgactgataagcccttaaaacatttggagagcagaggtgagtaaggacagctcaagtcaaggcaattgacatctgtttttgtcttggagcatctggtcgcccttcatcccacttcctttagagaactgctcctctctcaacacctgcagttctaatagggtcaccaatcacagaaacctcttctcacataactgccccaaccatctccccacaaaacacacacacacatacacactcaccaagtcctggagggaggatatgaccaaagcaggaacagagtccctccatgaactttccaagtaggaagtgaagatgtaaggctctcttgacctttcaattgtgaccctagggtactggcaaccaagaccgcccaccacacagaggaaaaaatgagggtcacacatagacagaggcagacattgagaaccagagatgaagcaatggtgagagacaaagtcctgctacagtttaaggccctggatgcagtaaccccaaactccacacttgatcctttctgcaattttgttacaagaactaaccaactccaccccgaccctttttcttttttttttttttttttttggcttatgcaggctttgagcagcatttgtgtcactactttggagtcttgcccaaattaattagtaaggaagtttcttcatttgaatgtgtaaggtcctttaagatttcattgaacctccctgaaacatgccatggcttgttggggtggggggaggttatcaggactggcaattactatgaataacagttatcaattaacggtttctgatgttttatcaattggtgagctgcaagtaatagaatgaccaaacaacagtgacttagacaactctgggtttattttctcacatgactagacatctagaggcaggtcattgctgctgttggtgcaatttctcagagatggcagctcacacgtctctggacttgtctattgctttctttctttggcctttctttcatggttataatgtggctgacacagctccacccatcacatcaaccgtcaagacagaaagaatttgggaaggagaactgctggtgatatttgttcctttatcaggaaagaaaaagatttcctagaatctcccagatttccacttgggtttcattggccagatacttgaggaagaggaggaggagcctgaagctgagccaggatttctcagacttatactagtggaaagaagggagcctgagagaaggtaagggataagacaggtctgagaagtgagtacatctgagtcgctggcaccatcaggacactttggaaggcccagacgtggaaggaaccacatagaaagtgctcatccaccttcacagatctcctttaaggtctcacttcgagatgctcctgaagcagagcagcctttcccaaagtgtggccttatacccttatttctaggaatatttataatttgtaacagatgggactgttgttaaacatatgtatgtatattcattccactccccctctgccttggcagggagtaaatttcctctacatgactgactttgggcttggttacatcacatgctttagccaacagaatgttggtgaaaatgatgaaagccaaggctttaaccatgtttgtggggtttagttgtacatttggcatctgtgatccaccatgagaagatgaagccctgaatagctgctgttctgaggagaaggtggagacatggaacgtacctaaacccaacctccagtttaacccaactaagttgtagccaacctgcagatatgtgagggagagagataaacgcttgtctttttaagccataggttttgagatggcttgttacacagcattattgcagcagtagctgcctaatacgtaggtgcttagtttaagttttggcagagcgcagtggctcacccctgtaatcctagcactttgggaggctgaggcaggtggattgcttgagcccaggagttcaagaccagcttgggaaacatggcaaaacctcatctctaaaaaaaaaaaaaaaaaaaaaaaaattagctggatgtggtggtgtggtcccagtactggggggttgaggcaggaggatcacttaaccccagggaggtaaaggttgcagtgagctgtgatcatgccactgcactccagcctgggtcacacagtgagatcctgtctcagaaaaaaaaaaaaagaaagtttcacagtggagtaagattagaaaattggtgagttaagcaactttaatacatatttttgtttttcagggattttttgtttggttggttggttggttggttagttggttgattggttggttggttttgtagaggcagggtcttgctatagccccagctggtctcaaactcctggactcaagcaatcctcctgccttggcctcccaaagtattgggattacaggcttgagccactgcacccagcctagtaaacatttttaactgaaagagagcatttcatgtggtgatatgttgtagtagtctgcttatgttgtgggtcgaattgtgtatccctaccctcaaaaaaataccagtacctcagaatgtaaccttctctggagatagggtctttacagagatcataaatgaagtcattagggtagactctaatccaatatgattggtgtccttatgaaaaggagaaatttggatgcagacacagccacccacagagggcagattatgtgaggacacacagggagaagatgatcaagcactagccaaggagagaggcctggaacagacccttccctcacagccctcagaaggaagcaacctgctgacaccttgatcttggatttcttccctccagaactctgagacagtaaatgtctgctgttcacatcactcagactccaacatatctttttgtgggggatatacaattcaacccccacaaaacgtatgcattatgaatttccaggataagcatatccaatatgttgggtgttaccatggactgaccagaaaatccgttttgaaaagtgttatctccctgcacacactttggaaatactggctttgaaggatccatggtttcttagacttatagtggtagaaaaaaaggagcctggaagaaggtaagtctgaggagtgagtacatctgagttccacccacaaacctgatgaaattctatcactcacttccaattggcacaactcatcatatctggacactcacaatgaagttagtattttaatagaacatagttgaatgaccctgttgaaatggccctgcaggctgggggcggtggctcacgcctgtaatcccaggacttttggaggctgaggcgggcggatcacctgaggtcaggagttcatgaccagcctggccaacatggtgaaatcacatctctactaaaaatacaaaaatcagccgcgcgtgctggtacacacctgtagtcccagctactcgggaggctgaggcaggaggattccctgaacccaggaggtagaggttgcagtgaaccgagattacaccactgcactccagcctgggcagcagagtgagactcagtctcaaaaaaagaaagaaggcagaaaggaaggaaggaagggagggagggagggaggggagaaaagaattatttgcagttatacaaataaaacaaagcagtaataataaaggaaacacagaaatgtgatccatctcgatcttttcaaatttcatgttcaaaataagaatcaataaatcctatgttgaaactggatcaaaaactcatattaatattgatttagagtagattctttcctaatgtgttaagccaaaaatagaaatgatcacataaccattgtttaaaagctgtaacattccccagacaggtttacttacacttcttgggttacgtttcccaatgaccttgtcccacttctgcacacgcaagatgggtaaatattagatctagtacaatctccgagtgtgtggtgctatttatattcatgcagagccttggctagccatgcacaacctaggaaaatgtctaaaaattgctttatgtgtacctaatttggaagaaatccgttagaaatacaacgttaacaattgcacaaaataccgaggaatatgaaaagtcagtaactcttatgtaccaaactacaacacagaagtttttataaaccttaaaaagatgtattcactcctatgtttcctctctttgatctccgtaacacaatagaataaagatataaagaaaagataaacctatattcttttagagaaaataggttcactttacttcccaacagttgtatccaccctctcatcagccctgccccccataacacctatcccaacagcacaggccactaaaaataataaggggctacctcgcgtaacagtgtagtatggcagcagaacatcctttctcaatactttctcctcatccctcccccaactgttctacaggtgtgacattgagagcatgggctatgggttcatggcattccaaagaatcagctgtccataatcccttgccccactctcctccaatttaagaaaatatatcatgaagcaaaagcacaagtgacagcaccaagataacactgcatctgtgcaccctggtttatacaccaagataacactgcatccgtgcactctggtttatacaaacaagcacatgattctaaatttcagtgctgcaactcttagtagtagagcaaatgtatttatattcatgtagagccgcgtggctgagaagtagggccttggagggaactgggtggaggagaagtgggaatggaggaaggggtggcatatccatccaagaaactgagtgtcaaccctttgcacataagaaatttggtcacggccacctactcattagctccaaggttccaaatagtcctgcactccctgtaacacagagagggagttcagcatcctcccttagatctggagttgggttcagctcccttagacagaaccatgaggacttcaaaatctactgccaagaaactgatgagcaggagccctcgacaacgctgcatataagaaggaaagggctgggttagttagcattatatttataaaactatgaacttcctatacaagagcatttcaatctccttacctctaccctgtaatggacctgcttccaatttctcttcacacagaacagttcaaattgttttagatcattagaacttaggttagtgaaattctaaatatctaaatacccctgaaagaattaccttgatagatgcaatctctgattattgtggataagaaaccacaatcaaatgtcccttatcccttttgtatttctttcttccatatagaaaaagtttccatgatttttcctttaaaaggaaattaagttatggtaaatggtgaaaaccctaaacagcacaaaaaccatctctaggaaaaagaaataaattcctagttaagaatacaaattctggccaggtacagtggctcacgcctgtaatcatgccactccaaagagttagatgtccataatcccttgccccactgtcctccattttaagaaaacacatcatgaggcaaaagcacaagtgacagtaccaagataacactgcactttgggaggctgaggtgggaggatcacttgagcctaggagttcaagaccagcctgggcaatatagggagactccatctctacaaaaaagtacaaaaattagccagacatggtgacacacacctgtagtcccagctactagggaggctgaggtgggaggagcgattgagcccaggaggtcaaggctgcagtgagccagtatcgcaccactgcactccagcctaggtgacagagtgaaaccctgtctcaaaataataacaataatgataataaatcacattcttaatcatcttatcaaaactagtcattttttcatctagcatgtatgaagtaggatcttcctataatactaaatcacagctcagtgatcttttaaggaggtagtgatcataaagttaagatcttagactttggcatgaaatagaccaatgccttaagacctagctatgctgcttaccaactgtgtgaacttggataagttgcttattctctctacatttatgcttcatctgtaaaataagaaaagttctagcacctacctcagatgactgatgaaatcactaaataagataatgtacacaaagcactaagcacaatgcctagcacacagttggccctcaacaaatgtctactggtagcactagcagtataatagaaacaacagcaatagcagaagattgctccccaaactttatttcacctagctccatttttggaaaaacataaaaaccccactggtagtaatccaccatatatgtgtctctcctccctttcctggacagaagagaggactccacctcacactcccttcaattatgtcactttcagttcaaggaattaaagaaccaatgtgccatctccagtcactctcctcccctgctgtggcaacgtttgaagccatgcatcaggatgcagaaatcctggatcctgagtcactgcatggaaaagacccgtcccacagagtcacctgacctgcttcttactttaagcaaattagaaataaatctcaaatatgttaatccactgagatttgaagtttgttagttactgcagcaaaacttaccctatcctgaccaacaggtactcctatacttctaaaagggatcctaatatacttccaaaaagagaagacagtttttttaatagcttgttttttgtcaatctttatattttttactttgtaagacatcatattgcaagtaaattgacttttcaaaatctctgcgcttcttcctcattttacactttttaatctaaaagagaaaattgcattttacttgtattaaatatacagattaatactagagctttcactgagtcatatgtcacacagtcacatttcacctatgataccaaggtatcctgtgatcacagtaagaccagaacaaggaagggataatggaagtgccctcaagcattcacacactcctggcttatggcaacctgagacggttaagtggaattatggatatcacctattctaaactgaactaaccctcatgaaatggacaaatggttcgaaatgtttttaataaaagtggaaaaggttttatatgtcactaaaatgtatctcaatgtattattttgctctatctcatccacatttaattcttcgtggatgtcataaaagacacataatacactggcagtgtaatgcatcctgtaatttataaataaatatacatgtataattggggtctgtgctcaaagataaacttaatgaaagaagcatgagataagtcactttggagctaacagtttaaagaagagctttcaaactttttgtccctgcttgcaccattcctaaactgctttaaccattttccaaaaaattaaaatgaagagaaaaccagtataaaactggggggaaatgtgcattgtacaaacaggttcataaagacttcatgaaccagcaaaatcagaaagaagcagaaatgataccgaagagcatcattttagagtgaagaacaaacctttcggttccaactacaaaatcacatttctacgtctgaaaactagctttggctctgttagataatcaaaaggataaggtgattgttttctacacatagaatgaaaacaaaaggcagattttcctatagatcacaaatgcttctacaggcgcttaaactccaaaggagtggtagccagggaaacagttaggagggtcagcaggtgactccaagaaaggcagagcacttcgttagaccaacatcaaagccagttattggaaaatcacttgttcagtcaacttagagttatctcaatttccttcagaaagttaaataatatctgggaatttttgagccacgtggtatcacattccctatgccccagctcttagcacttctataagcaccaattagagatgaagctggggccaggtgtgcaatcctagaactttggaattactccttgaagccaggagttcaagaccggccttggcaaaatagcaagaccttgtctctacaaaaaaaaataattttaatcggcaggctgtggtgatatgtgcccgtagtcccagctactcagaaagctgaggtgtggaggatcatttgagccgggaagtcaaggctgcagtgagctatgatcaacgtcactacactccagcctgagcaacagcaagaccctgtctcttaaaaaaaaaaaaaaagagagagagagagagagagagcaagagatgaagctggaatttaaacccaggtatgtctgattccaaagcgcttataaaaatagcagcattttaggaaataaagtaggcattaaaaaagaaaagaaaagaaaatagcagcatataaaacaggcctcacagaataggtgggatttggaaatgaagactggctgagatttaaagggaggtggcaggaaaagcaggtgctgagaaggccaccagtggaagggagcagcaagagcaagggcatggcagtgcaaaaccttgggtgtgtgcaggaattaccaggcagtggtacagaaagcacagatgtggagggaggcagcacaagataaggctggaaatgttggcccaggccttctagtagaagtgctatgggctcagtcaagaaggtagactttattctggaggcaatgagtaatcactgagggctttaaagcaggaaaatagcataactgcaggtagacaccaggaacctgtttttcctgtggcatgaaggatggatcaaagaagagtatgaaggtgacttacatatagtagatagttaattaatgctgaatggatgaaggcaaaaacaccaagttaaaaatttattgtgtatctctaacataacaaacccatttgatccaattccatttcatattgttcaatctgctacttagagaacaacttcactcattctagtgggaaataatggtgctggtgcttcaaaataaaaatcaattcaccagtcaaatgtggcccactaaatgttgctcttaaagtctttattcttacagaaattaacattttcttcttctattcagaaggaggtacatctgaacagctgttgcaactgctgaaaaagaaaacaaaattaaccaagtacaaaagttaggcaatgacaagtgatcctccccaccccacccctctccccatctgcaaccatgtgaaaaggttatcggaaaataaggaaattacaagctgtaatggtatatttcctatgctctctcatagtgtctaagtcaaacacatactaagccataaccttcttgatgatgccaaactttcttctgcacaggtcgtggtaccatctgcaaagcatcaactactcagtgagaagccaaggctgaaaaatactgagatgagtcatgacctacctgattttcttcatgggaaaccctcatctgctccttgaggacagacatccgcgctgcctcttctttcctcaagactctctccttcttaagctcaggactccagaaagtcttaatactgttcatggaagatcccaatttgctgtccttgatgtctagctctttccggaggaggtcattctctctctgcagttctttcagctgggcctgaagatctaacattgtgctgtctcttacctgcctcaacatggaggggacctggtggtggtgatgatgggatgagccagtcagcccaccatgttgatctgtgtatgaaaggacatctgtgtgggaaagtccagcagaagcaatattgggactactccccatggctgtgacacggcctccatatacagctcgatttgtagcccttcccagagtcatagtgccctttgggtaggttgttgaagccaccccttcatgatcactcagatacatgggtccagacgtagcataggctgcattgagggactggatattctccatagacagagtcttgcctgttcctccacctcccccactacttgttcttcggtggcccaaacgaggagaccttggcaaacgaggggatctggaagggctaccttccagattggtgattgttcttgcacttccatacatttttcttgtattatgaggtgttactgaagagaagaaatgctatattaagttggggtttgagctaatatttccacgattgtccagaattttcaccgcattcttttcacagtccgtaccagaaaataactccactcagagatctacaaagtgaaaaaaagaataattaaaaacaaatttctttagaactctaactgcattgtatttttaaatatataaagataatgatagatgtacctatgtagataggtgattaataatagacagatagaaagagccacacccataatgttgatttataaagaaaagcaactctagaactttactactacaggtgaaagttttacaaattccccccaccctgcccctaagcaagataaaaattctcaaagtgaaaaataagctctattctttaagaaaatgaagctctctatattggtttgtgctaaggttagagttagaacctctagaaaattccccatggaattgcccatcatggagaccttagctataaaaaggcccctcctttggggcataacccctatatgcatgtgacttgaaagtgactctgagaagctgctgattcctgggatgtcaaatatttggcattcatgttgttaccttcccctcctgtactcattacagacatcactaatccatcacagtcttcttttccactaggttcagaattcttctcaacacaacactctagatggcttaccaccaatcaactggtattaacacatgaattcaaacctactggctatcctggagatagaagaaaaagaggtagctcaaccaatgggatgcctaaacacatagccagatcctcaatgatattaccagagaaaacaacagtcctgtctcttttccctttcacacacatctttcaggctggcctcttgagaattatttcccattttggttgaccttaatattcatattaaccacttcatgtctgtacagaaatggcaaaggagaagaagttcccatcacggttactgaagtatactagtgaagattttatgtagctggggctacagcattgtgagtatcccttcaattttagcacccatatggccttaatggggcacattatggcctcctgttcttcctcttagaaagtctttactgtattttcttttccttcagctttacaacaataaaagaacagatttgagaaaggcaaacaggttcaaatgtccatgctaatactaaccagctgagtaaccttagacaaattatttaacttgttatgagcttccactctgcaatcaacaaaatgcaggtagtaccatctaactcatagtattgtaagaaatagtaagatgaggtttataaaacacctagttttgtgcctagtaccaaatagtcaataaatagattttgaaggtaagtgtctcaatgagataagtacattaatagcagtatacatgggtatcttttattttcacctgcctatcattcatcccttccccctctcccaaatacacactttctgattatactgtcactattttccttagagaaattgttcccaaccccctactcacagttcactgggtttagataaggttgactcccttcactccaccatcctggatggtgcaaggggtgagaacatgacccacgcctggccaaccaccatattgtatcctccagacatggtagctagtttagtgatgggcatgtgacccacattggtccaacaagactccatactaggactctagttggaacagctgggaaagataagctcttcttcagctggaattccttactttcaagatagagctgtgagtacttcaatgtggaaagggcctccctgagggtggagacaatacaaagggaaccacagctaaacttcaaagagtgtgaaaccaaaccaggtgacatcacttcatactccagatccaggaatcatagaagttaccatcatctatcatctatacatctgttccctggccattttagttacatatgccaggtgactgattgcattaaaggtctcaatcctttactcctttttttatatatgtcttggcagtgttttcccaatgtgatgctaggttcagtcatgtgactttatttgtccagtaaggtgataacaaatgtgaagtaagcagacgccttaagcaacacatgtgtttactctcttgctcattttcctctaccatagtaattagaatattcccaatctagcctgatgcaagatgagaaatataaaatagaaccaagttgtcctagccaacaggcaagccgccccaagatgtgtgagcaagcccagccaaagtcagcagaactgcctagccaaccagccactgcccagcggggcatgagcgagcccagctgagatcagctaaacaccacacttatgcacttgataaatgcttcttagtatgtcactgatgttttgtggtggactgttttgccacattacaggatcaatgggtaactgatgcatttgtctataaatttcctttttgctacattcaattctagatgagatttctgtcacagatagtgacacatacagtatgaaaaaatgttttctataaaggtttcccctttccctcaagaggtcttaaaaaattatacacctgtttctaactaaagaacttcatttcaaatgtttatgttgctcagggcttaattttgtttttcttggaaatacacaaaaaccattttgtatctaagatttttacatgaataatctgtagtgtaaaaaagaggggatcaatagttctaacataagaattcggtgacataaatgataagagagacagataatggaatagtggaacaggcagttacatgaatatttaataagacagaaagatgttcatgacatactggtggcagggggagcagacgacaaaacaattttgtgatttactcacactgttgtaaaacacacaaatacacatacaccctttcaccagcaaagaaggctggaatgacacacatcaaagtgttaccagtggtggaattccaagaggttttcattttcttctttttatttgcatactctaaattttctacaattgaaactgactcaattgtcccatagagctgatgtcagtggtttctttgaaaaaacatagaaattgacctcccagttttaaaacttgagaaagttgcatttgtcttatctgagttcctttctaaggaaaccaaccatcaggcctcccagatagtgtcaaggagctcaaactcgccagattactgcatttgggcaatgagatgtcagacccttcatctgtcataattgccttgccctatctgcttccttttaaccaactcctcttccttatccctccctaattcctgtttttccactcatgattacatttcttccctgctatataaacccttacgttagttggtcaaggagatggatttgaaactgatctcccatctcctcagctgcagcacctgattaaaaccttcttctctggcaatacttgtctcagtgattggccttctgtgcagcaagcagcaggacctggactgaacctctggtgttttggtaacataataatgatatatacttttttcattaaaaaaatgattttctttctatggttccaacagttaaatgaatgtatcttttctgtgcttacaatctagatgtctgggttctaactgggccaccacttatagagatgtcttcctagaaaaagtgatgaaatctaacttgtcttcctctgtctgctccctttgtatctagagatacacatttctgaggtctgtggctaggcttgaggtcccggaatgtcataaaatttacacgcacacagatttaatcctcagtgaatttacctgcctacctggccaaggctttggagaatcccaataaccaacaaacaaagttagtttgttccctttggaaacacacacacatataacatacaacatgaaaagatgtattatcatgtttgaaatattgtttccttatttaaaaagtaatatatgttgccactggcccatagatttcttgggttctccttttctaggtttaataacagatgtatgctagtatcatagatagattgagaagctttccatttttcatatgttctggaacagttagcataataccagtcttccctattcctgaaatattttgtagaacacacacataaaactgaatgggcttggcagggaatgttgactcctgctgtaatgctagctactgaggaggctgaggcaggaggattgcttgaggacagaagttcaagaccagtctgggcaatatagcaagactctgtctctaaaaaaaatttttaaattagcccagtgtggtgtcatgtgcctgcagtcccagctacttggggagagtgaagcaggaggatcacttgagcccaggagttcgaggctacagtgagctataactgcaccactgcactccagcctgggtgacagagggagagacccagtctctttaaaaaagcaaaaaacacagaatgggcctagttgtttattatcttttcactttttcactatgtttacttgtctatttgggtttgctacctattttgtgtcaattatcattaaaacgtcccttcacaaacagtctattccgtgtagattttccagtcttattggcattgctttgtataacttttctttaaaattttttaaatgatatagcttttggttttattaatatattttactgcatcttattttccatttcattgatatctctttatctttaataaaatttctacttcctttatggtttttttttgcccttttgcattgaatgttcatttctctttaatcacatttcctaatgaatgcatataagattatacacatggctgcatattccagaattctatgtataaaactcttattggcatttgtaaataccttgctgtttttattttgaaatttttctatcccaggaattattgagaataatatatttaaatgtcaaagtggatagaaattttatggtaaactttctagttcaaattgtatagcattgggatcataaaatgtaacatatatattttccaatctttgaaatttgtcaagactttctaattggcttattagtttttcttaattattaaaccaactaatagattattatagaaaatttagaaaatacaaatatgcataaagcagaaaatgaaaacactctcaatcctgtcactcatagataacctctattaacaagctagcataataccagtcttccctattcctgaaatgtttcgtagaacacacacataaaactgaatgcggccgggcgaggtggctcacgcctgtaatcccagcactttgggaggccgaggcgggtggatcacgaggtcaggagatcgagaccatcctggctaacacggtgaaaccccatctctactaatagtaaagtacaaaaaattagccaggcgtggtggtgggcgcatgtagtcccagctactcgggaggctgaggcaggagaatggcatggacccaggaggcggagcttgcagtgagccaagatcacgccactgaactccagcctgggcaacagtgcaagactctgtctcaaaaaaaaaaaaaaaaaagaatgggcttggcagggcatgttgactcctgctgtaatcccagctactcaggaggctgaggcaggaggattgcttgaggacagcagttcaaaactagccagtatgtattatgttacttccaattccttttaagtgtgtatgtgtgtgtgtgcagttttagacaaagccagacaatataaagactatgtaaatcaaactatataaagactatatataagtcttgtattttcctttttctccatgttttatcttaacatcatctccatttcccacttaacatagatgccacaaagtatttttataacacaagatttttgacagatactatgagcctccaaagatggccatcaaaagtcctctccttcctatacagaattgtctgtagttccattagttccatcaagaaattgattctatttcctttgtccttgaatctggactggccttgtgacctgcttagaccaacaaatgcagtagaggagacactgttccagctctgagtctaaccctaaagaggcttgacagtttctggttttgctctcttaaaactcagctgccatgatgcaaagaagtccaagctatcttgctaaaattaggagccacacagaacggccctggaagatgaaataccacatacagagagaggccacgtgaaggagaaccaaagcacccagccaagagtcagcaccaaaacaccaatccagtgagacaagccatgttggagcttccagcccagcccagccaccgtctttaatcagctgcatgaataacagccatcactatatgtaacaagaccaccaatcaacccactgaatcaggtgggaagtaagaaattattatttaaagccccactccaagttttacagatttttgttacacagcaaaagaactgaaacacttaggtaattatttttaaaatggaaatatcataattaatattgtgattgataaagctttataatattttgattgataaagcttttcaatgttccgtttgagcaatattcagattgataaagctcttacttccctaggataaattctttttgttgttgttgagacagactgttgctctgtctcccagactggagtgcagtggcataatctcggctcactgcaacctccgcctcccgggttcaagtggctaattttggtatatttagtggagacagaatttcaccatgttggctaggctggtctcaaactcctaacctcaagtgatccacacgcctcggcctcccaaagttctgggattaccggcgtgagccaccatccccagccttccctgggataaattttaaaagaattataaaataaaaatgaaacagctggatacagtggcgtgtgcctgtagtcccactgcttgcgaggctaaggcagaaggaaagcttcagcccaggagttcaagtccagcctgggcaacaaagtgagaactcatctctataaaattaattaattagttaatttttaaaaaatcaaaatgaaacaatttatactcacatccttactcttgactctctttccttcacagcttctactctactctcaacatatcccaaaagccaccatctcctcttgaggctacaaaaaaaatcccgaattacgaaactcaggatttcagcactatacattcagtaaatacacctaaagaagtatttttttatttatttttaaggcagagtatcactattgtcacccaggctggagtgcagtggagcgaactcgcctcactgcaatctctgtctcccaggctcaagtgattctcgtgcctcagcctcctgagcagctggaccacaagcgcacaccccctcgcctggcaaatttttgtaatttttgaagaaacggggttttgtcatgttgcccaggcttgatcttcaactcctaagctcaagtgatccacccacctcagcctcccaaagtgctgggattacaggcgtgaaccaccgtgcccagccaagaagtatttattaagtaccaacattgtgctactccagctcggctttagaccagtacttcctgaacagtctgacaaatgttcagataaacaaggctactggggttttcgttttaacccaagatgtctcagagacttttaggacactcatatgtattgggactgtcccaaaattaagtatacaatatagcttttccaaaattgatttgacaaccgaatcctcttcccttcagaatacctgaaaacatttcactgaacacttgaatttactcatgcaataaatactttttaagcatcagcttaactcccactgttgaatgagggggataaggcagtgattgagacagacgcaggttctgactatgggaagtttgctccctggaatggactttctccataagagctttcttcacctcagatataacaggatttgagaggaaggtgattacaggactaggcactgctttaagggcaggtacatgaaatcaaccccaatcagaattgacctctaacaggaaaagatagaagatcaaaataatgactagttgaagtttcagccctactaggccaggaaataaatataattctgtatttatttttcacacctcgacaaagaagccagattgttaaaaggaatacaagtcagccattgacaggctgcagtaagaggctgtggaaacacgttgttgcttacaacaccaagatcacaatgggcaagagattatgttcaattccactgaacttatcaaatcaaacaggaaattcacagaccatcaaaatggtaaaagggtaatgtcttcaccactgtacatctgcttcttaacaataaattttagttagcgacgtaggctcaccactatttgggaattagtttctcccacaaaatttataaagagcaggggtggtttcctgggaccatttcacccccggctgcagcacatagagtgataccaatgtcatggaagaaggaaagaatcagttgacaacataaagcaaaggcaggtccccatggctgtcatgttcccctaagcctcataattcctacttgttctgttgagtcactcgcaccctcccccatgccccacccagctgtgtttcatttcccgatatattttaaggagcttgttttgacacttgggctttttttttttggttgttgtctcctaatttctcatctatcctgatttgtttctaattctataaaataaatctctgagaaagagcaaaaagatcaactttattgagcaatcaataatgcaatcatgtcttccattgcccattactgacttaaaactatttttaagcttttccacccacctataaatgggttttaggaaaaaaggtagcagttaagatcttacagttttaaatacttattatgaagccaagacaggttcagtcattggacttttttgtgaactctttaaaaatacctacaattttttttttttttttttggttgagatggagtctcactgtgtcgcccaggctggagagcagtggcctgatcttggctcactgcaagctccgcctcccgggttcacgccattctcctgactcagcctccccagtagctgggaccaaggcgcccaccaccacacctggctaattttttttttttttttttagttttagtagagacggggtttcaccgtgttagccaggatggtctcgatctcctgacctcgtgatctgctggccttggcttcccaaagtgctgggattacaggcgtgagccaccacgccccgccaatacctgccaatcttatatgtttgtgatgtgcaactgtaagaagggtaaattattaattaggtcaaactgtgtacagaaacaaataaatgttgctgacatcaaaaaaaattataacaccaaaaaaattagttgcgcaacacccttcactttaaaagaaactcatgaataaaattcaaagtccaagggtaagttccgcttatggctcaaacaaaataaaataaaagatggctttatgaacctataagaatgctttctctaattgcataggaattcataaataagatatacagtcatccactcactctcttaaaaggcttaaggactcttgaactataagctcagaagggaaaaagcaggggagaaccttgattcctgtctaactcaagtatctcagactatcatggtctggaacagtctattttaagacaaaagcacttcctgctatctgctctaaattaggttaagtttatttccacagatctccgcctcagcccatcacctgaggcctgctgacagaccgtgtgagctgagatcatcagtatctcccaagattttgccaacttaaaatatccttttttttctaatcagcatccctaacttttccaaaattctgtgtcacagactactaattctaaaaacctttctaaaggaagacacaatggaaaacagatctcaaacaagcagtggccacccaggagccagatgttacctgcagatgtgctgtgtatagctagcacagtgttgtttagaatttctattaatagttgccaacatagaaagatagacagttcatattaaaatccagattctgatgcttccttaaaaatctgaaaatctgacaatgtcaggctcacctttctacatggcaataactggttggagcaaccagcagctgccccttcaagagaggacatgtaccctccagtttgccacagtctcctccactcccattatcttatattcagtctgattcctttcctgcctgcttcccccaataggtatttacattttttaccactctactcacatataaggtcttaaacaattcattcttttacaattcattcttttaccacccacttcaagttctttaccaaatcttattaattctacctccaaaattgctcttgaatcttctccgttgtttccactcctcttgaaccaatgtgactcttgcataagctacttcatacctcctaaagcttctcctcttatcgtcctctactcttatttccaaaatatcagctaaactgttttaagatacaattacgattataaaatatctccccttacccacttaaaacccttttaaagcttcctattgctctgtggacaaaaccaaaacgcttcccatggcctgaggccctgcaggatctgagtacagccaacagcccccgcctcccctcttgccactctctccttcaaagactctgacagggtcttcttcctgctgctccaatgcatcaagtcccttcctgtctcagagccttcactcctgctgttctctttgcagggctaattcctattatttcctattccatcacttacatgatagtttcaatagcataccctctacaagatctatcccattcaaatcaggtctctcagttacattctctcaaagcgtaatgctttttttttttcatgatgtgaaagacatgctatcttttttctttttataagagaagctgactggccaagggtcatctcaatggccctcttgtttaggttaaagtagagttagactaggtagcctgaatcctctggtgaaggtgtaaggaaacccttcataacccaactgaggctgtccctcctcagatccctggtttggaaaatgtgaaatcttgtaggtgtctttatgcacaatgatccgggaacattcacggagggaagtcactgacaccccagtcttaggtgcccaggattcagagtaagtgagatctatgggaaggaattagcatagctccaccagacttagagttcccagaaattaaataattacttcaagatagaagtccaggctggtgattgggactcaggacatgtgacccagtagccatggagaagcccctattgacaaagtgtgtgggtaaggctagaagcttctggagacctcgcatgctgtatggagcctgtacagtggggcacaaaactgtgcacagggttgtaactcatgaggaaggctatatgtcctagttggggttccccaccggcagatgctgagacaaggatgtgggtgtaggaggttcatttataaggtattcccagaaagtactgagaggacaatttggaactaaaacaaggaagtcaaggaagtcaatagagggcgcattttcttctttttttttttttctttcttttttttttttttgagacggggtctccctctgactcccagactggagggcactggcacaatctcggctcactgcaccctccaactcccaggttcacgccattctcctgcctcagcctcccgagtagctgggattacaggcgcgcatcaccacacccggctaatttttgtattttggggtagggacagagtttcaccatgttagccaggctggtctcgaactcctgacctcaagtgatcctccggcctcagcctcccaaagtgctgggattacaggcgtgagccaccacacccggccgagagtgcattttcaagaaggtttctgctgcaagcaactggaaagagcttcgagaaacagtggagaaccggcctcataggtgcgcctccggaagggcaagaaactccatcatgggctgagggatgctccctggcactcccaagtgaagccaaagagaaagccctcatgttcccatacaggccatgagtgctgaggagatgcgggtggggcaccaatagcatccgctacacccccacatggcacactgtgtctgagcttggccacgggggactgggttggccttcccttgcaggaccacagagtggggaccacagagggcacgcacagcatctttcagtccgagggagaacagcctcaacagcgacaccttgtggcatcaagatgtaatcatgtgatgggctggtcggacagattgatttccagatttggatgtgggatttatatccatatcccgctcgctctggggctgtgtaagcccgaagcagcggggaggagaggaaagagagggagacgagaagtggggaaggttgggaaggcggtctagtggagagattcggaacttccagctaaactggcacatgggttccagcattttggatttaatttggacaaatgaaactgggagcaagggttgtttatttgcaatatattgtaatatactaatcttagtatatctgttacaatatttataaaatatagagattatattatttacatttaatatttaattttaatatattctcttttcatttatttttataaactttattaaagcagaacatatacatgatgaaggtagaccttaattgcacacgttaattgatttttttttttgagacagagtctcgctctgccacccaggctggagtgcagtggtgtgatctcggctcactgcaacctctgcctcctgagttcaagcgattctcctgcctcagcctctcgagtagctgcgattacaggtgcccaccaccaagcccagggaatttttgtatttttagtacagatggggctttgacattttgttcaggctggtctcgaactcctgacctcaagtgatccacccgcctcggcctcccaaagtgctaggattacaggtgtgagccactatgcccagcctgcaccggttaatttttatatagtgagcacacctgtgttaccactgtctagaccaagacttagaacattatcagcatccccaaagcctctctcatgtccagtaatccgtatatgacccaaaagcacttccataccttagaatttcatattaatatgtgcaattccttgttggggtctctcttccctcctattataaacccctacactgcaacccaggtttttacattggtgctaacactcttagagcccatggcaagagtacaaatggatgcccagataccatgtgcctatacatttaaagttataaactgagctaacaaactggtaaacaaaatacattctaccttcctaccttgaatacagagatggggaaggtgagatctgaattttgaacttagaatacttagactcctcagaattccaccaaaacattgtggccggaggaaggcctgccccccacacctccgccaacaccctttctccccacctctggcccaaccataccccacgggcctcatacacatgaactctgcagcatgcaagctaggcttgctccagctataccaggggtccacaggctttctctgtaaaaggccaaacagtacacattttaggttttgtgggccacttgatctctgtcataactactcaactctgccatttcagcccaaaagcagccgtagacaatttgaaaccaaataggcatggctgtgttccagtaaaattttatttataaaaacaagtggtagttggccgggcgcggtggctcacacctgtaattccagcactttgggaggccaaggcaggtggatcacaaggtcaggagatcgagaccatcctgattaacacggtgaaaccccatctctacaaaaaatacaaaacattagccaggcgtggtggcaggcgcctgtagtcccagctactcgggaggctgaggcaggagaatggcgtgaacccaggaggcagagcttgcagtcagccgagattgtgccactgcactccagcctgggcaacagagcgagactccatctcaaaaaaaaaaaaaaaaaagtggtagttggatttggcccacaggtagtagtttgctgacacctgatctgtaacgtcacacatatgtgcccctccacaaccctaagcctaggatgtgcacagtggtagcctggcttacccccaagaagatgtactaggaaaaaatttccaggcagattctggaagacaactcagggtcatttaggcaaggaggtcacaggcctgtaggtacccagagcggactctagaatgccaggcacaggctccaggtgggcacctgcattggtcccttggactcttcctccagtggacggtgcagtcagaggagaaccagagtaggccctctcgcccaagagtaagggaacacgggagctatgcaaaacaactttgaaataattgaaaggatgatgctggcactttaatatcatgacattttcatcatatcactaaaatcacttccatggcagttataggacaattctgtaattgtagccagagaggagagacatagtgttttaaaaaggaaaagaggagcctcaaaatcagatttggctggagtcatatttctgtcttctggatacgcaatcttgaacaaagtattttacttctctcatcctcacttttctcatctgtaaaatggggatatcagacttttcgtatagatttgggaaagattaaatgagatgatataagaaagtacttagcacaatacctagcacacagctaatgatcaacagaagttaaccttgacaagcccaaagctaccagaatataacacagtggctttcagcctcaaagttgccatagaattctcccagttcactaaacttagccctgtcagacactttggagtcaaactcaatctgctgttcaaaagtgctgaagacatcaaccccagttctctaaaactagagagaaaaatggacattgccttcccccatgatctgcaggctacaatattatgcatccatagttattcaaagtcccagtaataaaccatttcatctgtgaatgccatgatgtgaatcagtaaggggaaagtccagcttaatacagcagagattttcaaaattgctttcccatcattctccaaaaagctctatgaaactcaaacacgcctatccacacatcagtactctctcctttagttcccccaaactcattttataattactgttttccatgtgtagatttagcatgattacatgttcagctgccttggctcatgttttatggcaaggtacttgagtcaagaggctgactgtcttccatactacaaggcaagggctctgcatgcccaaatattagttaactgttctttccattaaccatttccattatttaaatttcagactccatcaatttatttcaaagtgttaaattaaggatctgaaacccctaaaaattttgttaaagtaataaactattatctagtacacagctaaatccacaagttaaaaatatagcaaaacagccaggtgtggtaagctcatgcctataatctcagcattttgggagaccaaggtgggaggatcacttcaggccaggagtttgagaccagcctgggcaacatgacgacaccccatctctacaaaaaattcaaaaataaattagtcaggtgtggtggtgtgcagttgtagtcctagctacttgggaggctgaggcaggagagtagcttgagtccaggagttcaaggcagcagggagctatgatcacgccgttgcgctccagcctgggtgacacagagagaccttatctctaaaaaaataaataaattttaaaaatggcaaaatcccaaacaataaacagtaaaattaagaaataatttgagatgttaaataaaattaaaataagtgacgtttaataaaatatgctgattataacaacattattcatcgccccataaagtctcataaatagaacaaattaagtagttgcactgaaagaataaataaggttttcagattcgttttttaaacatctatgcatttcctttcatctgcaaatgtaaaatgtcaattggcaaagcttcagttatagtatacttaaaaaaagaatattcaggaattattgggtcttacactaaaaaatcttctatctgtcaactaacagacgtttctgagaaaatgatagagagatagaataaaaactctgcccccttggccctaaaaatccaatcacacaaaattttgctacatttataatggcataaggattacgtgtaaatagctttttactagaaaagaatataggcataatcacatacgtgaggaaaaattttagcaaagattgtaagctattaaaaaaaaaagaccacaatcaatgagggatgaggaatggctccaatgggcaaattatggagacaagcattcatctatgtattctggaaagaagagaaagaataaacgttacatcctaaatctgaggtctctcaaaaatatgactgataaccatgaaagagtcacattggaggctttaacaaggatcaagttcagggtgctgaatggtatacagaaacccccttaacaatggaaattagagtaaatgagagtcagtaagtgcagtaagtaaatcaagtaattgagtcaaatctcttgtctatgaatggataatggtaggcttatctaacataaaaataaataaaaagggaaattacaggacataattcggatctattcaacaaatacttctggagaacaaatctgtaatgtggtttctgacatgatagaggtccaaagccttccatttaaaagggggtcacagcctctttactcaggttcacattaacaactctaattgttgtgcaaggctgccagttgctgtgaacaccagaaacagatgagggcctttctgggagtgatagagtgtggtctcagatggagagagtcctatggaaaaaagagtgtagtaacagacagggaaaatccagttttttaacctggacaagaactaaggagggaagtcagatccatagttatgcatattaaagaatctgcaaatctcatgagaatttaaggcttgtttttatttcagaaatctgaaaacaaataatgtaaggatattcttgatcagcacagcaccatgcccattgactttgaatatcaagctgtaccctaaggaatcactgagtcaatgtgaaaggaaataagatggtcttggggatctaaaggatgtgttctcactgggtgaaaggtaaggattgtcaagttcctcagaaagaatgaaagtttcacagaagttgactatgatgaatatggtgggaaaattgaatcatcacccagtgcacagcagggtagaccagatgatgccaaagaacctgtccagaatagtcagcatcacattctaattataagcagcaatttagttaatgcagttaaattaatgttatgaatttgaattagtaatgtcatatgacatatactctatttctaaattgatttaggttttaaaaaggtgtaagagctttaaaataaaactcaccagctttatgtttatacaatttaaagtatcattacataataataatttaagccaaccctggggttctacgagaaattattttcattaaaaaagatatcatctaagtctgagaaaccttggttaagtgattaagcatacactggatttgagacctgaatctcacatttattatctgtttaaccttgagcaagttagcaaacctctctgagcctcagtaagtatctgagtaacaatggcctcaagtgtaacaatggctacttcacaaaaataaggtgaataatgattaaatcagagaaggcagaagtacttagcacagtgcctgaggcttagtaaatactcagtacaatcctcatcatcatcaatattgaccacaggctcattgtgttgttttcttacattagaccctttcttcctcatgagtaaaatagaaataacagcgttaaacatcttgcaatgggtctaaaaaaagtagttgattaaaaaggttgccaaaaaaaaactttgcacatgcaagtaaaactttagcccatgcattaaattgcatcatgtgttcaacatattcaccatccccctagcctgcccatccctacagtctccttcctgtgggaagataatctttcctgctccaatgacatctggcttggccgtatgacttgttttggccaatgaaatgtgagcagaagtaacaaatgccataaccaaacagtagctatcagagccctcttgtgggtaaaacattcttttttcttctctaccatgaagataggctgtccaagaaaggctccttcagcctgtgtcccagaataaagataacatggagcagaatcacagacaacccctgagagaaagaagccactgagatttggaggtcctttgttagcccagcacaacctagcaatatctgactaataaacccagctaccacaaacacagtgctaaaaccaaatatgtaacatttagattaaaatataggacagtgctttctcactgatttatctctcatttctctcttcctctgcagattaccaaactaggaaatatcatccattccatgacagaatatcttctgttaggtctccagatagatgcaaatcatttgtaaataatttattttcagatacagatgcatacaaccaactattttaattgcctccaaatgtattctctttatcattcctgaccactgatttctttactgacaaatagctgctcctggtgcttggacatcgagatgaaggcaatcactggaaaagccgaaaggaggataaatcctgctaggaggtgacatagttgtacaaacaatccaaatagtgaatgccagcgagcatcaatgggcgtgggctggacctcgtatgatcagtacacatgtgagtgcctgtcctggagcacagccctaggaagaatccagctgtaactgacccaagcatgcctccacaccaaaagaaaggcaacacatgcacccacctcctgctatcgtgattccatcttataatggctgtgtgacttacagattgcaccaactgatgaccctgtcttcacttgaaccttttgcaaaacagatgattcaaccctgtaccttccttaaaggcaagaactatgtcttcttcatcttcatatctcagcactagtttacacttgcaattaaaaggcaactcaatgtagagcagtttaaagcatgggctctgaagagtccaaattccagtttctccacttacttaggttaagatcttgcaagcagatgctctaagtgcctatcgatgtccctctgacctgaacattttagagtgccccaaaggcactgccaatatcagaatctctgcctgagagtatcttttaaacctggataagctagtcttcccttgcagggtgtagaagtcccagggttaaccacccttaaaaaaaaatctgacagctatttatacaacagtgttcacaaccgcattattcatgatagccaaaaggtgaaaacaaccgaaatgtccactgatgttgaatgcataaagaaaatgaagtatacacataaaatggaatattattcatccttaaaaaagaaatgaggaggccaaggtgggtggattatatgaggccaggagttcaagaccagcatggccaacatggcaaaaccccatctttactaaaaaatacaaaaattagccgggcatgttggcatgcacctgtagtcctagctacttgggaggctgaggcacgaggatcacgtgaacccgggaggcagaggttgagaggttgcagcgagccaagactctgtcactgcactcccacttgggcaacagagtgagactctgtctcagaaaaaaaaaaaaaaaaaaaggaaatgaaattctgatacgtgctacaacatgaactttgaaaacattatgctaagtgaaataaaccagccacaaaagctcaaatattgtctgatatcatttatatgaggtacctagaatagtcaaattcatagagacagaaagtataatggtggtttccaggggctgggggaatgtggagttattgtttaattagtacctagtttcagtatgggatgatgagaaagctctggagattgatggtggtgatggctgtacaacattgcaaatatacttagtacaccaaactgtgcactttaaaatggttacaatggtaaattttatgttatgtatattttaccacagtaaaaaaataaaaataattaaaataaatttaaaaaaaagaaaagaaaaaaaaacaactgacatgaactagtggtgagacatccctactctcctagcctttgtgtaaaaataccctaaggcaggtgttttacactatctctacaatttccttatgggattaaacactagttgccattgcacaactcgcttaacaatgcaccatctattggctgccttcacttccctgtctcatatcctcattcactcactagtgaccccctgtaagtcccaagtaactatttgtctcagggtctgcttctgtgggaaagtcaactaagacaccaaggcaagtttcttaatttctctaaacattactttccttatcaataaaaataatacttagatcatgaagttattgtgaagattaaacgagataattcttcaaagtacttagcacagtgcctgactcatagtagatacttaatatgatcttcttgaatttctggtctaacaattatccaccttttttatagaagataaactacgtctctcagtttcaggaagagactaaaaaaatctaagagccaattctttcccatcttctatttaaataacatctctcatgacttagcactcatcattcaaccaaccacaagaggtattagaaagaactggaattttgtatccagctcaatcttttgcctagaggtgggctgagcccacaaaaaaagttagataagctccccagatagcaagaagacccccccaggacagacagataaccaccactccctcctgacctagggaattagagggctgtggggtcaattgtaaacaactttgatctggtaaattttatgcgtatccctttctctctttggttacaaatgtaccctcctaaggtttatggcaaagactagaattcatttagtctttttctagttccacagtgcatcattttaacaaatgaaaccatgggatcatgaaattcccagtgaggtgaatcctttgccaaatgccattttattttgctttgatttctcgttacttgtttgccaaaatacacagagattttatcacaataatcacctattctgactagcaaaccaaaggattaggttacatactctggtggactcataaataagactgatgagaaatccaatttctgtctcttgcttttgtagaaaacacctttctgaatatgtactttttaaaaagctgaacaaacaaaacttaccttgacttacatgttaaaaagggaagctctgttccccaaaacaaataaatgataaaatcccaaattccatcttgctctttaatataatccctaaagcttttttccaacatttcatacatacatagcctttaacttcactcacaactataaatagttggccaatttaagttcaaagcatctgactaaagctaaccactagccatattgggcatgcctaatggtttcaatgtttggctcaattacattatgagctaaatagttctccctgtattattgcctacagttttccattttccacttataaattaatgacaaaattcaagaaatattcaggtgattgcacaaactgttgtacaaatatggtgatgctgatgaactaaaactacttgtcggcaggtaaggtcatggtacagtagctcagaatggtggttcataagctacagcacagaagattaatgtatgaaaggcaatttaacagtgctactgtataatgtacaaaagtgtaaatcatatcgaagtaaagtaagaggcagacactatgcacgggatattgaatagtgttctagcccataactcccaatcttgtacatttcaaggaataatgaaactatttccattcatgaactttctcagacccctttcagaagctgtacactatgaattacttcaagtatttccctcgattaatctaacaaagtcagtttcattctgcccattaagtacaaagattttgaaacacaatgtgtactctctgtgctctgcttaaaatttattgaaatgaactttgtcctaggtgatattgggagagagtctcaaaaccaacaagtgatgtggagtcccactgcagatctttcaccagcagatatttttcctcacctggaaaatggtctttcaaaattattaaggctgtataaattgtgtttggtcaatgaatcagaatggacattgctaggagtcccaaagccataataatcaatctttctattgttcttcaggtcatcttgccaccctctcttcccaatgtcaagtcccacactcccacaagcatcaaaagtaggtaattattgccatgacggtgaaataaaaggagaataaagagaattcagagtccttgatcgtatccgtcccctacttgaaatctcttgaagttttaagcttgagtcccatctcctcaatggctcacagggtcttatgccctgtcacactctctggctcctctcaccatccctcatcctgagccaagctaaactccagctctacagttctacctacatttacctccgtgaaccctgaatctcccattctctcgcttacctttggacctagtgcatgctattccccctgttatttgtaccttcaaatcctccctcctctggctaattccatttacccttcagtgacactttaggtgctactttcttcaggaagccttccttcattcttcatccatgactctcctaagtcttccatgatagcctggatgttcccccaaagagcatccattattgcctgcttacttgtttggtgctccactggatactacaatccctgaactcccctacaaaattacctgctctattatggtcctcttgacgtgtacacaccctattcccagaagaagactggcacaaagcaagcatacacttttacgacgactacataacagaatggcttaattctttgttactaatgtctattatgaaagaacaccagccactcctgttttccaggttaaaataactaataaaatgataattacttagttgaacctttgcatgaagaaactgttgtaaaaatatatatataatagatctagaagagtgcctttgaagcaaattggactagatgatagagaaacagagatcccaaataaggagaaagctagtggcaaagccagaaagggaacttagggcttgtgaccccaggtcagtgctatgtctctgtatccaaaagaatctgctctgaagttattctaagcaactattcatgttgtgaattcaaggtggcccatgaatgcattcaaagcccatgtataaaaagagagttatttctcagctttaacaaaaaaggtgaagaattccccttgcgtgcccacactaactgctccacgctcacaagcctgatgaacagcagccactaagacccaggtgcttttgtatccacccagcatcaaacaggacctattttcaacaagcccatacgaatgccacgctgttatcccactcactacccaacctcctgcttcctgtcagggagaggcttcatgaacaatacgaataaagggtcaaaatgcgaaacaaagaagggggaggagggaatgttacagccttagaagggaaggaaaaacatacatcaccagaaggaaagaaaagacatcaaaaatcctctcctgagatgtcaatgtaaaaaaagagtcaacaaccctgctcctctcggaacccgccccttgaaccacgactgctcctcgaggtgatgacagctggagctggctgacaaaacggagcatggctaatctgcctcaagccaggcacaagaaagacatcttggtagaaatttgatgcccaccagtatcactgagaaaataaccagtgatcatgggaccgccctaacctcacatctggcagagctgctcaactctcactgccagagcagctcccagaccccaaacccaccttcaatcacctcaggcccatagaggatgaactcctgaccacacctatcttattatagagaaatatgccacataagaactggtaaccacagtgcacaactaggttcaatttcttataggaaaccctgctctttcttactgcaattagtcataccatttagcagaaatctttcacggtttgcataaggatctgagcatattcttaaagaacagtcacattgctcaattcccattcaagctcttgtcttctgacccactaagaagttgccttgaattaatagtttgctcctaatgcatttagggtaaatgcactttgctgcctgcaactcattcatgccctgaaatcacagaatgacaactacctttaggggtggaaagtattaagacaggaaaagagagctaatgctatcagaccacacacacacacacacacacacacacactcacacaggataattaagtgagcaaaatgtagactctgaaaaataaaccatagcaaaactaagttgctggtataagatgtctatgaacattgcggctggcctttggttttcaggtatatctcacagatgcccttccaactcttcatccagtggggctataatctcaccattgacttccaggaaaaaataaccacttagttccttcctgaaggttcttcctgcctttatttattttcttctcttcttccatgcacacgcactctctctctttttaattttgttgagtgctgattaggtgccagcaactagagattcctgggctctgaccaagcgaactctgcttggcagagtcaacatgagttcaagaacagaggaaatgcaacttcaaagcaacaaatctggaagatgtaagtggagaagtaatgcccaagaggttaagagcagaactttgaggcacgccctgggaattggccagccaagtgctgaagaaattaggctggagtagcagatgaactggcccaagagaagggtaaccaattatattaacaattaagtcagtgatgtagtggccttggacttccccagctgaaagaatgagcagaaaatcacaaagaaggctcggccctggctgtgaaagtgagacagcttagagctcctggtgcttttggcattgacaatggttaaggcttgttggttgtttctgttgtaattgtggggccactcattgtttctactttctctagtgataatttagcagccttgagagtaaggcagaggtggattcaaactctggctctgccacagcattaactctgagcaagtttttctgttccttcagtcatttgacaaatacttacagaacatctaggcactagggatacagccaaaggcaaagctcctgcctttatggaacttatcaaattatttgagtctcagtttcctcacctataaaatgggataatacatttacctgtataggtaatatgaaatgagcaatataaagcacctagcacagtgcctaccacatagtaaatgctcaataaatggtgctcttcatataacagagcaaacgtatccatcacttccaactggagtattagctccaagtagtaaggaactatctgttgttcatctctgtacccccagtgcctaacacaaagtagatactcaataaatacttcacaaatcaatcactacttaataacagccattgttatggtaacttatagtcattattcctctctaagccacagagattctatacttgaaaaagcaacatggcggcctagcgtggtggctcacgcctgtaatcctagcactttgggaggccgaggcgggcggatcacggggtcacgagatcaagaccatcctggctaacacggtgaaaccccgtctctactaaaaatacaaaaaaaaaaaaaaaaagcaagatggcataaaggctttttttttttttttaaagaacagtgaggtgcactatacaatatgtcttcaggaactttttaagcatgaaaacaaatgttattgagcataaagctttcaattcaaagaatctattagcacagagaccagcacggacagcggatgtagatgccagcccactcttttcctaactacaaagtaaggacaagctggccaggcttcaggttaatccagaaggcacccaaaaagtaagttacataaagtttagcagatgtgctcaaagatggtgtatcagtaaagataagcagaaaagtgctgcagaaaccaaaaatcacaaaactcttcatggcttaaaacaaccaaagtttacttcttggtctatatgtccaactccagttgacgggaagctgtgttcatttagtgactgaaaggcccaggcagatgaagggctccatctcaacacacatttccgtaatcattgcagtagaagagggcactgggtgctctcacactggaaatcaaatattctagcatggaagtgatgcaagccacctccaacatatgcctggaaggaaagaaaaagtggctatggggaacattaacagtctctaccacagatgatattaagacacaacctgtggaataacaaagggatttgttaaagatgatgcacaaataaaacatctgaacagctataagattcacataatcatgaaccaggaagggtgtgtaggtgtcattttagagcagtggcctcaacataaagacacttcatacaacataaatctggaccctaaatttccagaacagctctgctttctataaatatactgagggtccagataaatttttatttaggaaacaaagttttaacagctgaaaaacatttgaaaactatgaatgtaaaccaaatcctttattttacaaatttaaaaagtaaagagaagaaaaaaaggagacacagacagttaaagtaaccccaatctacccctcaaggaaggtctagaatgtttagcagaaataagtccatggacagaatctaatgtaccactgcagcaccttctgaccttacccttcatctctgctacctttaactggcacagtggagccagacccagaccaaagtcatttaatacaaggtcgtcaagggctcaataaatggtattgacaatgagtagaagaccccaccccacagcatgaaatagtgattcatatctcattagcaattctctacattactcattccctacttctgggcaaatgtgaagccatcagtagaagtgaatactagccttcaggagactttcattttgctctcagatgatcataggttaacagcaactatgatttgggttcactcaattccattatcttctcatgtccccagctctgtttcatgcccagttttccctccaccttcactcgtactaaagcatgtatgtcatgcactcaagcctcagtggtctcccaacctctggtctctgtctttttcaatggctttatactcactagcccatgaaatcaaactcaaatatttcaaccaggaatccagatgcctcctaaatcttaatccagcctaattttccaacattatctccactatggtacttgtcctgcacagccagaggcaagatgatgatcctgaaagtcaaaatgatgttgttttgaacccccaatgcttctacttactggttgggcaagtccttaacccctctaagttttaatgttctcacctgcaaaataggtgatagcacctactttgagggttttcttgagaaggtatgtatcagtgaggagtatgtgcggctgcaagtaataagtagtggcttacaagtaaagagctttttagttttatgcaataagaactacaggggaaggcagtctaagctggtactatgaatgaacgatgtcaccaagaccaagatccttccaggctccagctttgccatttgtaagacacgattttggctgggcatggtggctcacacctctaatcccagcactttgggaggccaaggcaggcagatcacttgagctcgggagttcaagaccagcctgggcaacatggggaaatctcatctttacaaaagtatacaaaaatcagccaggcatggtagtgcgcacctgtagttccagctactgggaagactgaggtgggagaatcacttgagccggggaagtcaaggctgcagtgagctgagatcggtgccactgcactccagcctgggtgacagagtgaggccctgtctcaaaagcaaacaaaaaaaaacaaaaaccatggctttatcttcattgttgtagttggctgctgcccctccaggcattgcaccaatgatctcagcagcaagaagttaaagagctgaaaagttcttggagtataccacccacgtgtgtctcactcactacattttcaggaaagcctccacccaaaaacttccacctatgccattatcagacccaactctcatggccactctaagtccaagggagtcttgggaaggtgaggtgggcttatttccatctcagacaaaattggggttcttttagttggaaaggagaaaatgaatgttgggtaggcaaccagcaagcctacccaatattaaatatcttatggaaagtgctaagcacagtgcctaacacatagttaactgcccaatagaagttaagctataaatactagtgttataattattattgttgttgtaattcacctttcttactctctggccaagtggaataactcattatatccatgtgtgcccctacatttttatggtatccattgctctatctgcatctccaactctctccctgctttaaggtccaggaaaatgccattgcatccaagaagtccttccttacacctattcctaatgataagtttcatggtggcaggacccacatcagaataaaactgtgttcaccactgcactgaacattgtctcttggaacacagtaggttctaataaatagtgccttaataatttaagtaattcatgtgtatacacaaacctgttttatagccagccctctaaaatcaaacagagaatattcctgaaatgcagaagttaaggaccaggtttatatgtcacgcagctagcaatgggagtgaggggatgaaaattgcattccccaagaaaaagaaaaaattagaaaatcctctaaccataatttttacatgctgttggaagctggatgatagttcatcaaatattcgctcccttactgtgaacagagtctacgtttacagacaagtgttgtccaaaatagtacttttccaaaacaggttattagtgaaagtgacatttgctcgtgtagtttgcctcttggctccagtgatctgccaggagaaaagcatgccccaggtagctgccatcccttcagcctgggccccaggacacatgtggaggagactggaacccaacccacagcctctacacagccaccccaaggagcccaacctataccagccaaatcacggtcaacctgaagacccatgagtgtgaaaataaatacctgttgctgtaagtcagggagttttgttacactgccaaagctgactaatatatcttatcatttgatatatgttagcatgtcttatatcttcattcattttgttccttttcttcacataagaagaagaggttgtagagtctccatgttttgtacatccagtgagttctacctttggatcaactattttaaatttatgagatctacattaccatgaatattggtgcttttctgtgctttccattcatcctatctttctaaactaagaaaatcacaataaaatataaaggaatagtgtaaacattgctgaaactgaaactgttggctggcaagtagatgccccacggaccagccaaaatgttaactggttagaggattttaaaaaaagaaaaaagaaaaaaaaaaaggctagagggtgtcctagtaaaacaagcaaatgcagattgtacaaaagtcaacctaaccaaagtcaaagactctttaggtaaatttgtggactgcaataccattcaccttatttttcaggatacctgttttggcaaaccttcaccactgagtttcaccaatgggaagagactgataaggcttacatcttgtagcttttccaacataacaaaacaagaggggccggtcatggtggttcacacctgtaatgccagcactttgggaggccaaggcaggaggatcacctgaggtcaggagttcaagaccagcctggccaacatggtgaaacccagtctgtactaaaaatacaaaaattagagaggcatggtggcgggcacctgtaatcccagctacttgggaggctgaggcaggagaatcacttgaacccgggaggcagagattgcagtgagccaagatcacgccactgcactccagcctggtgacagagcaagactccatttcaaaaaacaataaaaaataaaataaaacaagacggtcatgctattacaaaagaataattttaaatatcattatacctaatcactaatggaaaagggtctctgtaaataacaaagaaaataaaaccctaatcccttggtggggagacaactgaaggatgttaagagcatttattcaaccaagatctatttaaaactctaattggaaatttaaggtgtcaagaaaaatggaagagtgtgaattttgttttgttttaccttcttttaagtcatcatcattaagtttggaaccaaatttttatcgagccaaaatttttattttattatgtgttatattttttatattttattatgtttctactggaaatatataataaacagagttactaaatttgcctattggcccatgccacagccttcaaatgcaaaggcaaaacaggctgataaaaggactgtcagaatcacagtggactcttaaaatggttagctctacgtatgctgggagaacccacacttcagactggacacatgcagactacacaaccaaaatttgaagtcaaggccacggccaaggtcatgggctctgggtaagacgaacccgggctcaggttcttgctttcatactaaactgtggcaagatactgaattccttctagttactcatctataatttgggcgtaagaatagtacctacctcacaggggctccacaaggtttaaaaaagataatgcatataaagtactcaacaaagtgcttgcctatgcaataacaatgatgatgatagtaatagtaataatactgctttgacaaacccggcttctacatgaaaaccattctaatcagtatattctggctcacagtctgtttatgaaaggcttaattcacagaattatgttcacatccaggtacaacttctataaagtgacagctctttggatcaatcagtaatttttctaatgaattcagggagaagggtgttgaaaaatcaggctttcactagtagtgagttgagatggatctggtccttcacccatgattcatccacccgtgaaagtcttgctggtgaaaaccatgacaccatcaccttccacacccctccctgccaaaactgtaaaagtattttattaaagcacagaagcaaacagacaagatggcttacatgagaaaaaggcaaactctactactccccggaaagaaaatggcttgaccccaccaccaccgaactgacattctgcaaaagagaacaaggcagccctcacttccagaagttgagttaactgtcagaactaaaagaatcccttctattcatgtgactccccataaagaacgtttgccggctccaaaaataccttataaatccatccagtagagccaagccccaagtactgtatactgagaaacaatgtgactttacaaggacaagagtgaccataggagacaaagtgccacacccttttcccggatagctcaacggtacatgttgtctcttataaagactgcaattctggagaaataggtgggcaattctaacaccccctcccccaattccttctttacacagattcattttcatttttaagccagtggcctcggcatccgcaactactacaactaataatcaggggggtggtgggtaagggatggggaggacaaggaaacacaggtcaaatatacttgcttctaaaagtccattttcaaagagttttcttcccgcttgtctgcctctcacagctgtatccccataccaggtggaaaccaatggttaagtaaaatcactgatttaaagagccaaccaggaaactaaccatgacaagtgggagctgccctcctctcccgagcattgattggttctttgggttccaccggtccccattctacccacgtaagtggcaggtgtggctgtcaatcacagagggaaccgacaattcaccgctcggggagtaaattgcctttcatacagcaaaggcaggtagccgcctaaaatcgatccactcctaaaagagcggaccctccctctctggcaaggagaacagagacccttaagtacaaaataaataaggcagggccgaacggagagtttacgagcgctattttattaccccgaaccaaagcagctcttaatcttcactgtcctaagacgatctttcaaaggctcgtacggtattttttttaattaggtacaccttcgtaagtatccctttttttgtataattaggagatggggaggaggagagaagggatgccgttcagttcaatttcacatcgtattccttttcatacaccatcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagc

SEQ ID NO: 438 - DNA, 21557 bp, Homo sapiens
atgctttgctgatatatttatttacatatttccccatttcagatgatggtgacaaaaagtagatggagaccccaccctatccaccccccaacaaattacagacacagatttcacttagcatatagaagcattggggcatgtccaaattcattccactgggttactacagccaggagagatttgatcttgggggcagtctgagcacctcaggcccagaaattgagctaaagagaggtcgccattctgggccttgccactggtgtgccagcagaggtgacagaagagaatcatggtgaactgagctgtctagccctatcatgtggtctagaaggtgacagtgggctcttggatagcttccagtgagatccacagtcccacagaaatctgtgactcagggttttcatctgcaaaatggggataagaatcctgccctaaagatgtcacaaggctatcatgaagctccaatcagacacaacttgtcaaaagtgctttgccaaagttccagtgccatacaaatttaagggaatttgattgattgattgtgatggttagagtgccccgggtataacagtggactggtttatgggtccaggggtcaagcaagtgatagaactccgacagtgtgccctgggtgggcaccaatcaatggcgagtaatgcctgttgcaaagccgagtttccttagtttcttggccccaggaagtcaccaaggcctagtgcctgggtcagggctaggggaagtcactgggaaagttacagaaagagtcacaggggtcaaagagaaggaagagggtggcatataaagcagggagtagttactataatcacacacaaaaatagatacccattggatgaagggcattgaattggtagtgcagacgaaagatggagccagcaaggagagggagatgtcacagcagcagagagagaggaatgctgtcccaaataggctctcttgctgcccccccctcttcctaaagggataatgccagtgtctatctatctgcagagaaaggggtagcagggagagagaactgagaacataataatctgaccaaaggagagggatctcttcctcctgttatactgctgcccagcatcttaatgaggtgccaggtataggcaagcaactagtcggtgcactttgaggctgaggccagaactgggccgaaagcactacaaaggcaatagtgggcttctggaaaaatgcagtaattgtctggtggtcagcattgttggaagatagctaatccgcctgtacttaggcatggttttagggagctgatcactaagtggctgtggttttgaacactgagcatcacggatgctccttgaagaagagggaggtggcccatttattaataatttgaaatggtctgctgagaagactcagtgaatgggccaggtaggggagaggggcagcaaagacaaaccctctgcaagcttctgtttggggaatggggcaggaaaaactctagtcgctcctgctgctgctgctgctttcccccaactcccttggcaaggggcttggacctcctggggaactggagaggttgccccacagggtaccagctggtacctacaagttaaggcaaacaagccagtagagcacattgaagaagaagaaagtcactgggaaaacaactctcgagtagttatccaggcggtagacatggatgcagaggcggccctgctgccaggtactgccctcacaatcggggaccatgcagaagtacttcttaaaacgcttgcaccactcacagcaggccagcttggagcagaggctgcggggaccctcagggctacctgggctagggggctgctgggctgagcaagacgggcgctcctctccatcacttccctcagtggtgacaatctggcacacaaaagcttcctgatgttggcgggcacaggctcgggaacgtgcacgggtacgggcatgggcacggctattgatacgaggctaaaatggacaaggaaagaagtggggaaaagtcaagggaagataacccaagtctaagtgctgcctccggattttctggaaactgtctttggcacaccatatcttggcttctctcctccaacttctcaccattacatcaggaagttgattcaaccccgccaccaccctgggtaacattccatcactcagcaagctgaccacccatgtgccataaccccagtacccttgctagcatgtctctacactccaaagccttgccaccactcccatacccagctcatacatggcggagtttaggagaagcatgggcttttgtctggttgtagatcaggaagttgagcacagcaaactccaacagagcgcagaagcagaagacgaagcagatggcgatatagaaatccaaggctgtgatataggagacacgcgggaaattcttacgagaaaaggtgcccaacgtggtcatggtcagaacagaggtgatccctgcaagagcacaagagtgatgggctcagctcctgacctatgtgcgacattggttaaaagactccatgacaaggcaactctgccctggcccagccaactcccagccatgtgcctatgcgtatacctgtttctcctcttacctagagaggtccgggctggagcagactctgtcttgatccaaaaggaaacccaggagagcatcgtggtcacggaagaagggacatagttttgaaaggcaacatagccaaaccgcctgctcacattgaagaaaatcgtcatgaccatgaagtcacctgaaagacacaaaaaacatcactgcattacagtgctgacacgacggtcccccttagcaggacgtgaacagtaagggtctcatttttcagctcacagtattccctaggatagaggcatgatgtgacaatgcaatacatacaaataggaccagaagaagcccagaaaaaagacttactgcaagaccaatggccagttgagagctaagccaaggccagaatcttaatagcttccttctcagttcactgtcctacacccaatgtctgtctctgcaggttggcaagagagtcaggtgaaagtgaaaaaatcaattagccttctagatatcatgcccacgcagctgatatccagatggctgactaagggcttcataccctctgaggcacatcacacctgcactgctggccctcagaatgtctactctcagcaaatgagactagggaagtctgtgctgtggtggagaagcacagaatgcttttggcctcctttctgcacattcatgtgatggcaaaatgccttcgtgagtgagcactgctccacaggtggtcaaaaccggcactagcctgctccccaaagttttggtggctccctgtttcacatgagctatacagactatctgcactctggaatctgatgctaaaggcccaccatgacccggctcccactgacattttccacacgcaccttacccaaagccaatcccatctgctcacagatttcctgagatggcctgcaattttacaccaagattctaaccctggactctttggtcttagtctatgacccctaacccaaactgagtgtttcagggaaagagaagaaaaagcttaaaatgaacatttcagtcagccctccagaagtcaggtctgtggcatacacatccacagggcagactgaggtcctcacagtcacttggacattgtgtccttggtcatggctctcagctagacggtcatggctcctccgggacctgatgacaacctatatctctagttggcatcttcttttgtagcattcatgctgctttatgctctgacacaccctccccaagcactctgctgctatcatgactcccaggctggtgtgggcttttctctgagcccaggacatcattttccactttcagcatcacattgcagttgcaatactgtaaaattcctaggcctataattaggtcgtcttttaagtcccttcaaggcagggctcatgcaggccctgtggcttagcccctgcccatccaagctcagaacagcctggaacccagcagacactcagcaactcttgctcctgtcaggcaacagctttgtaaagcagaccagaacactaacctgtccgtgtgtcctcctattttggaaagtggatcaactgcccagcaggtctgggtgggctggagctgaatgagaagagcagcctttcgtactcaccttggcagcactgaaactcaaggagcaaagcttctcagattcttctggaagaaggcaagggagcgacctgttgtcagtgggaaacctgtgtgttgagtatagctttgggatagaactcctccagagctgctgcacggaccaccctcgcacttgcctactggccagaatgtatttatcaaaagtcctcttgccgtgggatcttgactgcaatttaagacacttctaattagttatacccaggccctgcaaaattgctgggtttatataatatattcttgttgcacgaagatttattattctgttggatgattctattttaattttatttattctggccaaaaaagaaccttctccgctcgtcaagagatgccaatttgtcttgaaggacaagagaaagatgctaacacacactttcttcttcttgaggagtgagagaagcacgggtaaggaaaacaatatatctggggctgatgaaccaaagcaaaaaaatatatgctaaagatggttttctgctcaaactcttatcctctttgaccagatcatggttggtcactgcagtgtcagagggacacaattaaatagaccatgtccagaggactgggactagaagaatgaatggacccaaagctttgaagaataagggaagaaaaataaactagggctatgtagactacaacagactatgatccatgccgggaatgatgatgttgatcgtttaatctcggtcctgtgaaacagtggctggactaatgtaacctggacagttccaaggaaaaagaactaagcttaatgtgtggaacttccagagactccaatttcagaagaacagggagagttttttgatgaacagaactgtctagagaagaaggaaacctccttgtaagacagtgaattcctgaccagcaataatattccatcagaggctccacagccatcagtgaagggcaagcctctctctggaggcagggctggactctcttagaagctcctgaagcagagattctctggatcaaggtccaagatggccagagtagcaggctaccactgcattctgaacccttaatcgccgagcacgtaagtatgctccagatggagagacctgccccagggcccaactggaagagtttgagaccagtcccaaagataactctgacattgaaggaaccacgtctccagatcaactagtctccagcagaggagaaagaagacctcttttctcctcaagaatcctcctcactcccaaggaggtctggtgcttacctactgtcattgctttgatgatgatgctggctctggggctttgtagtcactagggcaccattttgaaacaatgcacaatcatctactaaacggaaccactagtgacttgaaagcccctgggccttatcttctctgtcacttttgatgatgggtccccacctatccgggaaaagctgaggtgcagaaaaccaagaggcaggcccatggttagctggcagaagagcaaggctcccaagtcaaaggtagtaaaaccgcttccccagagtccccaagaaaaagggcaagtatttttaaggtagcccagccctctgcccctgcctaatactgtgcaagcaaagctctagccacatgagcatgagctttccctcatccagagactgactcaataaatgaaacaaaagcagattttctgcctagtcacatggtagcagaacaagatgcctctcacgacaaatggctggttgggtgactggctccatccacattctggaaacgatgagggcagtgccttcactgccctgaacttggtcaggatgtgtgaagagtgtttccagggttgctctgggagctaccctggggaggtcccttggctcctcattcaggtcacctaggaacataagtgaaggtgctcacatctaattgggagctgaagtgtaagatacccaggaccttcccctttagtctttgtcagagaaaaggtcagaaaaccagtggccactatgtctatgtggaatccaccatgaagcctttgataagaatctgtgcttttcagacttgttcctttaagataaatgtcaatgcagcagccagtgtagctgctgtaacttcctccagactttcccagccttaaactagctgacattagaactctagcctccacctcccactacaatggactttgcttcccattcaaccagactggattggttctgggtatggagaactcacacgagctccattccccaaagtcatccaaagaggtcagagttgtaacctcgaaactgaagggtctgcatgaaaaagccagctgcacattccgacagcagcagaactttatctacttacctaacctctcaaggagcttggcaaagcacttacttctttgcagatgagactgagacatagttacaaagtctcagtttcctctgcaaacagttgtaagtgcttagcaattataagacaggagccatgtcttacaatgtttgcacgggatgactgcaaagcatttgtatggatggccatctccaatcatccctaccaccttcctggacttccgccaagccctggcacgcttaccaactggggttgtgattatttcagttttgttgctcactcctgtaaaatcaaactggaagagcttccaggagttcttctcattgatttcaagcttgaaattttcccacttgtagatcatctcattctcaggataggaaactggaaaggaatgtgagaaagagggtcttatgagacttggaagcccacctgaggtctccaatagcatgaagtcagcctgcacaatgccttggagtcctgtctctggcctcaccagctgtgggaccttgcctctcttacctcattgttgaagtccattcaatgagtgcgtttactgagcattcctcagtatcaggccctaggccagaaatacagagatgagcaaggcatgaaccctaccctcaagcaatcacatttaattttataagacagtgagtatactactgtgatttttggaggagctctgaaaaacctatgtccacagaacagcggggaaacaaagtagataaaggtcacttggggacatactcagaaaagacttcataaagcaggtgatattcccattaaatcttgaaactcaagtaaatattctcaataagaatgaggttgaaggggttaaggggcagtatagaaaggtgaaacacctggtgtattgtggaaaggacaaaagttcaggatggctagctcacagaggatgaggtgcacaggattgggtggcagggtccagttcatgaatggccttgaggttcattctaaggaatttcaaattgatccatgagagttaacggcagattcgagactaagaagtgacccaacctaggtgacccttcagctaggtcactctggtccttctgtgaggacaacatgttgtcaaggaggccagtgtagtaatccaggcagaattaaattaatgcaggtggaagtcaaagctgtacagggtgcagagaaatagacagcatcgatagagactgggaggaaacaccaacaggatgtgctgattgattagatgcaggaggtgagggagagggaacatcaaagttcttgatttgcgcaactgggtgagtgatggtcctcttcaatgagacagatgggaacccagaagcaacacacttgttttggtggtagaggtttggaggagacaatgaatttcattttggacatgtgcagtttcaaagtgaagatgtggcaaaagtccaggtggaagataacaaaggcctaaaccaaggtagtgccagtggagatggagaggagcagacatacttgagatacgcttcagaggcacgtggaagggatgagcaacacagtattgttggcaggaaaggaaatgagggtggaggatggaagtcctgcacaaccttggcagcattttagaagaaaagcagaggcagaaaaatgtaaatggcaaggatgagaaaaagaaggagcccagcatgtttctggggccccagaaacttaagaaggtactcacagctagagaaagatagagggcaagagtgagaatccattggaaatctgagcatgtggagtgagcatccggcatcaatggtcatcctggaagggagaaaggagcctcatcaggctggccctaagcacttccgtatccacccagctttggtctagggactaccaccaatgaatggccagagtcaatttttttctttgtttgtttgagacagagtctcactctgtcacccaggctggagggcagtggcgtgatgtcagctcactgcagcctcttgcctcccaggctcaagcaattctcatgccctagcctcccgagtagctggaattagtgccagcacaccctgctaatttttgcatttttagtggagacagggttttcccatgatggccaggctggtctcgaactcctgacctcaagtgatctgcctgcctcagcctcacaaagtgctgggatcacaggcgtgagccaccgtgcctggacctcgctagaatttaagacaaaaagctcaaaggagagataacaagagagaaaacaaaacaaaacaaaacaaaacaaaacaaaacaaaacaaacaaacagcttagaagtatctggttactctgggctccatcattagagaaacgtatggagcaacttcgatcggcttttgttttctcgcccagcctagtttccaggacctgccaacatcctccctgctatcccccacacacaaccttcccctgctgggaattcaagtatccaacttgatcttaggtacctttgccactaccgtgctgctgctctgcctgaacaattccaccactgtggacgtatctttgtatcgagtgcccacgtaggatggaattgtctagataatgcagtcatactggcacatcctagttgagggagctctggactcggagccaagtaactgagtaccagttccagctctgccacaaacttggtgtgtggctttaagcaatatctttctattttgaggcctctatatctgttacataagggggctgagctcatggtctaggaaagctggacaggcccttagaggtatcattcaggatgagatctctgcccatggatctttagctaaaattatcagaaggggagagagaattccaggaagtgagactccagaggcttgacatacctaattgtgtacaacaccttgccatccttgtagatgcggaccatctggttgggcatggtgatctcatgctcgtgggtcctcttagaattcctaaaaaaggtgtccgggatccatagctggctcaccacattgccattcagaacaagagactcaaaggtgtcgttgtaacagaggcgttcgtcgtaccaggtctgggagaagatgatgtcaatggtgtattcctggtgggaaggacagaaaagcacatacttggggatgaacagaaaaaggacattcacatgcaaacatattgtttgccactccctaacctagaatcctaaaggcaatgtggtggaatgcattgagcactagaccaggaagcaggagtcagatgaggtcccttctctctgctcaaagactcttccaatgtcagaactagaagggaactcagaggttaccaagcctaatgatcccaaatgagaagtcagtcatgccctgcttgattaccgtgagcaaggggagctaggtcctcacatcatgcagcagttaacacaattctcacacaactcaggacaatagaaaagtttgccttaaacaaagctccctactactttctcttagaatccccactgtgctctcaggtagcacatagagcaagtctagtttcggttccagaggagagatctccagaaatgatacgtcattgaatctgtctttttcccacatttctgaagtcagggtgcaccttacaattgacacatatctttaatggggcatttcttattctttcttgacagtggcttaaattggttacgatcttaaatcagagccaacattgaatcaaggaaaggcacttgaagactggaatcttgccctcctgagtcttttctctagggtagacattcatgactaaaagttttcagcttcaacaacccaaccacttgttttaccaatagatctgcaaggattgcacagtcaactgacagtctgctcacaggcgactcttttcaccaaagtgtgatagtacttgttagtacttggtccatagcactactactcactttgtgctgtgtttatcctacaaggtcaaccacacatttgaaaatgattccacactttgggaaagtgttgcccaacagaatggcaaatgtgactatggtccatgcagatcttactgacatggagcaaattgaaagacactactggataaaactgaaatctagagcaccttcctggtcacaccatagtcaagactactggattaatgcagctgaattaaggaagcctatgatcactaggtatacatgatcaacatgaacacaacaatgggataggtgagatttggtgatctttaaaggtactgttagctctgacgttatagattctgaggattttcattagcacatgtttcaggtttgtgtgtcaccacaactatccagttgtttttatgtttccttataagtgagaataagagaacatttcacttaggcaaacgataagacaacataggacttgatcactaaaaatgacatgtctgtacactacgcccacacgtggaaatataaacatggaattatgtcaaaataaaaaaagattagaaaatatccagaagacactgactgacactacagaaaactgaatgcgccctacaaataaatgatttcaaggtaatgtggaggcaaggagaactgttagactctagtgacaattagtctcacttttttttttctgtagaattgtttccatttataatcaaagtcttaaataaatgttcttgtgaccttggctaaaactcgtatctttctctgttatcctctttgttaaatgggagactataaataatttgtaagtgccctcctcctcaaaacaactgccctgtttccagagctgacattgacaccctccctttaccagtgggcaaaggttccatgctattctgtgatgggcttatcaagtagatggaccctttggaatccacttaggtttgtacagaggaaggtggcatgagtttggctgtaggagttttctatttccaggtgttccaaaataaaatataattcccaactagatcacagtctcagaggatacatttcatctagaaacagacaggcgatggtggcttaattccatgggctgggctcttcatcttattgctcctgtgtaggctgtgatgctactccagccaggtcaacaccctctcagtccccacatttccatagtaaatcaaagatcccagctcaaaattgttttaaaaatttacaagcacacacaccattgattgcatacagtggagtttcccctttcagcttttatttggggagcaccagtgttaattaaccccaatccttcattctccagaattataataaaaatgaagtgttttggaggccaggcgccatgactcaagcatgtagtcccggcactttgggaggcacatgtttaaggtttgtgtgtcaccacaactatccagttgtttttatgcttccttaaaaccttctgggaggttttacagccttctgggagggcggatcacgaagtcaggagttgaagaccagcctggccaacgtggtgaaaccccatctctactaaaaatacaaaaattagccatgcatggtggcaggcatctgtaatcccagctactcaggaggctgaggcaggagaatggctcgaacacgggaggcggaggttgacgtgagcaaagatcgtgccactccactccagcctgggtgatggagcgagactccatctcaggggagctgggggggaaaggagtgttttgagtcacaagagaaacctctatttagtctcatgttttttaaacaaggagaatctttttttattttgcttattttgtttttcctttcaaataagcacctgtaacctctgaatgtgtgtgttcgtgtgcatagatatatccgtgattatttggtctccagatattgtctgtcccataaaatgtctgttaaacatcaacaatgatattgaataggaagaagctagaaatgtgcaccactggtggtgaagggagaaaaaaaccctactgcaatagaactccaagcagctcgaacagcaagtaccacaagcaggccaaggcagaactctgagttattttagagataaggaaactaaggctttatgagaaagggggctatccaaagtcacacaaatagtcaatggcagcctggccctgggatggctttcacttgcaccaacaatctctttaggtaccaaggtccaattttctctgcagaatccctaggtctttccgctgacttcttgtgcatcaaacaatgaatacccacaaccatggaggcgggcacagccctcggggaagaaatcaagaaaatccctgattgcctttgctggccaggacaaaagattgtaaaagcagccaccaaactgctgggggccagccatggaagggaagactgagaatgttccctggagtaggccagagaagcagacagaaaagagctggcagagcctggctcccatttgaatgagagcctctgaccccgacctgccccacctgcctccacaaatgtcttccaagtgtttctactgtcccaagtggctggcagtctaaacttggccagcagagcctccttcattcccaggcctcgtgaactgcttggtagccagtgggaagccttgccctctgcactcacactgtgtttatgctctatgttatgaagtgtttcaaataagcatttaatttctattcgacaactgtaagttcattacatatcaaccgataactaacagttcactttttccccagtttgacaaaggagcttgcgatgtacatcccttttagctcagccgaaactctagaaattcagtgttttggaactagaatcaactgcgataattaccacagcaagaaaaagcgttagcaactatcgatgctatgatgggcagcgattcccagattgttcattgccttttaatctcagactgggtgttacacaactgtgcactcaggtttccttcccggaggacaaggcctgctttctaaacaacatctgactgaaaggtgttgaaactcccctcaagcaactacaccaactatgtacccaatgctgggactcacatttctgagaagtctcagcttcctcaaatgtaaaacagggatccatatcctaacggcagctttggcttccatgcaggctgtcatgaggatccaaggagacaagaatgtactgggtactggtatgttctgtgactatgtggcagagacgtgtgtcccctccttaccaagtacaccacagaacagggacctcccacagctttaaagaactatttggaaccatgtagaaggcaaggcatttcaggaaaatttaacaccacatgtgagggtttggaattttcaaaagacacttggctcaggctaaagtgccaccttactggccaaagaaaataaagttgctgtctcttttctgaaccagtcctgtgttccatgctaggtttggtgactgctgggttattagactatatccttcaagcattgtcaggtgaggccactgctggcagcatgaatagccatggagcaaggagagacagcgcattcagctactgtgagtggggctactgctctgctacaagggctcttgtagatagaaattggcttcccaaacagcaaggagattttagtcacaaattctccactactcttcagttttacaggatgctctgtctcacccagaaagcaaaccgaagcatcttggcgccccctgctccatttgtcagtgtgtggttctctccactccacctaaggaaatttagccaccaccaaatgggtggagattgacatgctagaaaagaaggggcaaaccagcttgtggaaattagaccggttacttccaaatcaggttggcagtgccttagtcagccaaaggagcagagaactagaagaaaggaacaaataaatagctatgcaaatttctgggagccatgaggttactgtggactgagcactacatttggcttttggcatgctgaagaggataggcagagactgctgtaggaggctctctgcccagctagaatagcatcgtgagccactttccccactcctacaccaatgacctgaaagggtcaacagtgacaacaatggtgggaccacaagccctcaacctctggttcttgcacagaacttagtgcttcttagtttataaacaatgctagcaaaattaattgctaaattcatacccatttttaaaaggtaaattgcaagactaaaaggagactacaattctcatagtggtaaacgcactggtagcagcaaaaagtaaatctgattatcaagggaagagtcaagaaaaccccaccaattttaaaatgtagacagaaactcaaaaacatctatctgctctcatgcttctgttcttgttagttctcagcaactcaattctaggagttgctctaacagaagaacatcatgaccatgtgtagccggcagactcttgagatgtcctccagtgctcttcacttcctggtgtttgtgcccttctgtaatcccttgacagggattacacttgacttgggatggacctcatgatttgcatctgatgaggagaataccacagaagcaatgggatgtcactcctaaaattagattataaaaagtccgtgatttccatcttgagcaccttctctcatactcttcctcactctgaaagaagccagctaccatattgtgagctaccctgtggataggtgcacatggcaaggatggagggagacctccagaccacagccagagaggaccagaatcctgccaatcctgtgagtggtcttggaaatggatcccccctcagttgagccttcagatgagactccagccccagctgacaccttgattacaggcttgtgagagaccctgaaacagagaacccagctaagccatgcctggattcctgacccacacgaactgtgagataatgattatttgttgttttaagacactatgttttggggataatttgttacatagtaatgcataggtagtgtgcctgaagaatcaggcagccaaagcctcatggtttgggagtggggaaccttgcttttccacttagcctatgcgaacaccttgattttccatgaaggttaacttagcattgagggtctatttgcaaggcccatctcagagccaaggctctaactcacccagtcacatggcactttttgagtacctgtgagtatgccaaaattttgtttgccccgggccaagccatgtctgtggctgtgacggagttgcttaccaaagccttcctcagtgtcaggctctgcagatgcaagtgattcttgcagagcatcattcatcactcatttgcttagctaacatatatggagcccttgacatcaaggagttcatggagaagacagcaaggccgacataccacagataattacaatgaaatgatgtaggcaagatcaggtaaacacctgtgatataagctggaaagatgtaactgccgaagagaagaatgtggtatgagaaagaaaggagcaattaacaggtgtggaggtcaggggagatgccatgaatgagatgctgtctgagctagatactgaaaaagaaggcagctgacaagtaagaaagtggaacaatggcataccaaatagaagatcacttgaatgaaagctcagaggtacaaggtggtctgggaacaccaatattctagtgtgaccaaagcacgtggtctctaaaagggtgaagaggaatacaaccatggagggccttcaactgcatgtagtaagcagtgctgggactgcaggaggtgcatcacttgggaggccaacttagtaggtggagtaggtgtattctaggtgggagatgatgaaagccaaatgggggcagtgctgacactatgatgatacgagtggaaaaggaaagaaggaagtagagcaaaaatatagaacagtcttagagcaagagctagtaactttagacttatgtccatacaataattatcagaagaaaagaggcagtccattgtggtgtttaacattgctttattatttctattttgaatgaaaaaactggaagatatggtcatgattctgaagatcctcttcaagtagcaagggacttaccttttccagtctcattctcaaaccagtggttaaaaaatccctttctccctccagaaaataaattattggagttgttacagaagtacagagcagaaagcagaagtctgtggaaggtcccataggtcagcccctgggctaggaaatagtactaaaaaagcttagtactcaccatgtctaggatagagagaggaccaaggctgttgacggagatctcaacagtgaccacagtgggcttctctataagggaagcagaagcagcagagggtaagtgtcaaacaggcgcatgggacgggggaggaagtggtcagaggggatgaaaggggagtcaagtaagtgttggaccacacagtttcagcatctaatcctatttctttatttattctttcatggcaaaaccaagctcacggactgttaagaattggacacacatcttgaagatcaacaatctagtttagtcctctcattttaccactggaaaaactgagggcgagagaagggaaaagtcttgatcaaggtcaatgacactgctgagaatagagttaatatctcttacctgacaggtcaatagcagatgttcctgtccatgagcatggcaccctctgttactgcccaggtgcattctccatgcctatgccctcaacccctggaccctctaggaggggaagaacgtcgttctgctcctcacctccaatgccagggcgcagtttgtggtcataattactcaggatagtgttcaggatgcgagaggcttctggcagtttgccaactctgctcccagtctcagtctcagttgactttgtttcctcagagaggagctgattttccagaggctggggctgggggccatagacaacatcacgggaagaggcttcattctttgattcagtctgaggtccctcgaccctagaacattcaaacgaaaaatgaagctctgccctgcactctgtaggggccccagctagtgcctcttgggacagaagcaaaccaaaacaagttttcaacacaaaacctagttaaattgtgactggtaatagcaaattataagacagtgacagattaggcttgtgaatttcttttaaaccttgctgctctttggggactttctatgctgtccctcttttatgatcactcttttatttaagaaaaaatcaacaaaaccaagacctagattttaaaagaatgttacacgtgaaatgaagagggcatttatgtctgagcgctggcccactgtgactagccttggcctctagtcagcctgaccagcaccaaccaggagtgaggagcaggcagagggccagggctgagaggaatgcttgcgaaagccagagcggcctctcccagagaggaccagaaaattgtgggaatattttgcggttttgttggttgtgtaatactcgttgcactgggggcaggggaaggggatgaagggaaggaggctaaagagcagcctttgtgggtgtctaaacaggaaaggcaggagtcctccacccacagacagccatccaggaactggctgcccaacaggagtccaccctgagctccacagccatgcaccacagccaagaaaaagaagaagattagtaagaataattgaattaaacaaaaatgttaaaggccatctgccaaggtatgaaactcaccgatggtgttagaagtccggatagtgctgcctttgctgggaggcagtgacaaagggggcttctgaggtcctgctcacattcgggtccttgatttggctttctttacaccgctgtggtcatattctgacaactcatcagctgtacacttatgatttgagcacttctctgtatacatgttctaattccataaaaagtgtttttaaaaatcaaaatgccccacttgctaatatctggatcttattttatttaaaagcaaactcttgaaaaacaaacagaaatcatttatgacacaataggagagatttgaacactgagtggacagttgagacatgaataaattattctttaatttttggtgtaattatggtattttcttatgtttgtgaaatattaatgactagaaatacatactaaaacaattacatataaaatgatatgatgtctgagatatgcttcaagacaatctaagttggaattggagggtgggtggtgtaaaagaaaataagagtggccatgagttcacaaacaatgggggtgcactgttccccctacctttatatgtctttaaaaaattataattaaaagtctttttaaaagccatcgtcccatattaatctgtgatactggaaggcaggagagtggtttcctttggggaggaaagtgtacggggacaggcattttggagatgcatgcgtgtgtgtgtgtgtgtgtgtgtgtgtgtgtgtgtctgtgtgtgtgtgtgtgtgtgtgtgtgtgtgtgtgtgtgtgtgtgtggtgagggggttgcaatgctgtatttcctgatctaggtgttggttacacgggcctgtttacttgtgaaaagccactgagctgttcactcatgatgtctatgcttttctactggcacgtcacacttccaaaaggatttttttaagccataaggcaatttgtttcctaaaataaggggtaaacagggcaagagacgttggcatgacccctgtattgcggaccaagggactgccaacttaagaagcaaaatgcattttttctgcagtatttcaagctgttagaattgcttaagtggcatacagatgtgccaaatccacaccatttctcatgtctgaagtggctacttcccattgtgggcgagggaagaactgggcttggaaaatacagtttctactttcaaatgccatatctagaagatgtcctctttccctgaggccaaactcccagccatctcaaaagataagggccagtgactatgggaagagaggaggaaaaatggagccctgagaccctgtaaaatgagtgatgtggctggaaacgtggcacaatcagaactggcagtcagtggtagactgagcactgccagacaggaccacctaaacgcctgaagcagcccctcccagatgtctgaaatccatggacgagatcctccccgctgccccaagtttaaaagtgcagaggcaaacaaataaacctgaaagcactgagaccaccaaagccctcctgcccctagactaggtctgcaataaaaatgatatcagagggtcataaggtggctttaatcctaaaattggcttttgccagttaaaaaaaaaaaacacaacaataaacaaacaaaacaaaacctcatcttgaggtccttggggttaaagagctgctgacaatgcatacctttccccagccagccattaagctcactttcggggctagacagaataaaaacttgaaaaacactcacacattggaatagtggcattttccagggcagtttttcagacattcacatgtctctagacataatggtccagcatgaagttgaatctctgcactaccccctcccaaacagtcgactgttggtggtgtgagaagtgggggggggaggggcgcataagaaaagatgttggatttttttctaaatcagatcttttttttcattctacagatggacaaactgaggcccagatagaggaaggactgtgccccaagtcacacaactaatttgaggctaagcctggaccagggagaggtcttctggttcagtgtggcccagtacaccccattgtcacctcctcagctctttcctgacaccacaggttgctatgcttgaagggcagtttccatttccccagtcccttttccctgctgttttcctctctgaccaccccttcttatttcccccaccccagagccatcttttgccctagccagtcaccacgtcagctttctcaactagtccacatcccattttgagggatgtggatgactggaaattgctagcacgcatagaaagacatttatcaagctcctgctgaggctagccccactccagggcaccagtgagccagcaagcagctacacatccccttctctgatgagctaacgcaatctggggtagggagagaagccaccctccctccccagaacagacaaacaagacacaagcccagtgccatggaatcttcgagaaagctccacagatcaggaagcttgcaaatttgtgacacttcacacacagcaggaaccatctcaaaacaacaacaacaaaacgaagcagtcatcttccaccccaaaaagccacaaatccagggcacgaccctcctagccaagtctcagggcgaggagaaggtgtgagggaagatggttgttcaagggaaacctgaaaggggagaaggggattgaaatctacggcccaaaccacagacttcagaggagaataatattcctggcctctggctccagtctgcccaaggcccagcagggtgtctagggatgagttaaggaagtgggaggctgtcagcggtggagagggggcatagctggtgcgggaacccttagactaaaccaaagctcgtgcctgagactggcaccaacaggagcagcggcatgggaagcaagtaatgtcagagttgcctggcgcagtgcctggaactcagtaggcactcttaaaaaaaatgtgagcagcagagaacacacgaggcaacactcacacatttttggcgcagctaagctccctcagcccgcgcacccccttctcaaaatgcacctccggcccccccagtagctgaagcctgccctggccggtcaccccggggccgctcccctgttcctgcgcaagactccgaggagtgcttgtcaccaggccaccgcagtgcttctgagagcgggaatccgcgaactggagtcccgtcttccttctggcgtcctgtcttccttttggagctccccctcaaggaccccgggagcccatcctacagtgaggcgggccgaggccggcgcgcatcgaggggacgcgggactcggccagcccgcggtagggccggggcaaagcgggcgcggggctcgaggaacgcggggccgctggggtcccgggagccgtcccggctcccggggagagggagctgggcgcgaagggctcccgggtcccgggatggagactcacctcgactggaggatcaataagatgcctaggaggactggaagaactttggacaacatttccgcggagaccggcgcgaccacctgcgcggaggtcgcggctcacgctctggc

SEQ ID NO: 439 - DNA, 27483 bp, Homo sapiens
cccatttgtcccttcaaagatttttttttattaaatggttttttaagatcctaaagtctcccagtttcccctatatacataagaccatttaaaccacaacctggttaccaccgaccctttcgtgatgattcttggccaaacccctgaactacaagcacatccatttacgcctgaaaccagaattgtcctgagattcgagcaagacacaaggcggcaattgggtaccacagcttcatggaagtaagtggtgggaatttgcatattattttgttaaatgagggtccagttcttttgggccatggcccaaatttgttgatcccagtgagggtacagatgagggcctggatttagggtgtgcggtaaggactgcccttcacagaagcaaaacaggcagctgcccctttcagcaggctcggagtctccctccaaggcagggtctgccccgagggcttacagggggtttttccggacatcaatcatccccgggctggctcgtcgcagttcccgccggggcttggacaaaggcccaaagttccagggcaggcctgcctcacccacaggaagcacccgccccaccaggggctcagccgcctcccgctgcctcagttcctcgggggacccctgctcctcaccacacaggctcgagcgtttccaggtcaagggtaacggagcgtggaccaagtcccgcgtctcctcccgggtgcggggggccccctcagtgaggggggacagccagagaagctcgggtgccaggtggagctcatcttcatttccaggagcctgtctgccctccgagcacaggctcctcttctccccacctgtcatggagagtaacgtgtcctcatcagaaacaggtggcaacaccttcccgaagccctagctccccagtgccccagcacaataagcaacctgtgaattgagccaataaaggctcgagggagagtggtctctaagctttccccaaagaaagggaacaggtctgacttcagagcgcgacgaggagttacccctgctgtggcctacagcgttcacaccgccgagcttctgtttcagttcctggtttatccacatgtaacggcccagttccttctccagagcttgaatccgggcctcatactgcctcctgctgtctgctaacccttcaccgaggtggtctagagtggaaaggtcgaggagagggtggtgagggctgcaggcggggcaggcggccagggctgtgggggtgggggctgtgggctgggtgggggccggggttgtgagcggtgggccgggccaccagggctgtaggtgcaggggctgtgagtggcaggggcggtggggggagggaggggggtgcagggcggggaagatgggggtgggggggatggagggggccggggttgtgagccatgggccgggctgctcacctcgactctgctgcaggagcagctgcatgttctgctcgtgctccttctgctgcagggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctgggagcaccattgttgtatgagctgtcattcactgaaatgtcacacagcacatgactatagtcacataggctttctctctgctcagggaacacagatgtgtgggcatgaggtgcactgagtatgcgcctgacactccacacacgaagccgagacgtgtgggcaggtactcgaatgcagcacagaacaggagtccaggctccagccagaagagagctgagaggtcagcacagcctggcccctgtgtcccagccaatgaggccaaagcaggggcagaagggccaggccagccctccccagcccccacctccacctaacagtgaaaacttgggtctgccgacagcaaggcccagcacccgcagagggctggagcaagggctgaggagagcagacagacaggcatacaatggcaccaaggggctgagccatggggccgcagggtacctcgggggacagcagactcccctgcctcagcttgccgtcgatctccaggcgctgcttgagcagcgagtccttctcctggcgcaggctgtcgatctccccgcggatctgctgctggctctgggcgctgccctgccgcagctgcccgctcttctcggacagctccttctccaggtgctccagccggctggacactcgcacgatgtcctcgttgagggcctgggggcagaatcaccagggattagagaaggaacaggcactgtcctcacaggggggacagaaagggccggatgttaaggaggacttgcgtccttccctcaagaaaccaacactccaaatgttctgctcagcagggagaccagacttagttcacagagactccaggaggcggggctaaagggaccagagcatttgcagaggggcactcagagatggcgagaggaggataaggaccagagggacgtggccctcctggcaagaacaggcaatgggtaggggtgggaggaatgatctgtcactgagatgaccggactggacagtgataggaattggccaagccctaaaggcctttctgggagccagatgcgggaggaagtgagggctctcctggcggagggaagttacggatcattccagtaggaccctggatcctcctggacatcagagtgatgcgtgctggcaggagcaaggctcctggcctctgcgggcctaggacactgggcgtgtggcccaagcccctgtactggaacaggccctgcatcaatgacggccatccccctccagccatcatggtaacattatgatcccatctgacagaagacaacgctgtggctcagaagctgaccttcctattctagatggagtaatgatgccaggcggagaagtctctttctatttggctataccaccttcctatacctgcgcctcctcattcttcctgcacaggccctgaggagggggttaatgagtgaaatgaattggaggatggacacttaagagaggttcttctatgcatacatctgtaactgtgtcataaatatcttgaagccctacagctcatggggatgcacaggatagaacccagtaggacagagcttcctctgtctggaacttacctggcagagataccacctagaagaaactctcctgtctagacctcgcctggcagggacatcacctggcaggtttatcacttggaaggacctcactttgctagacctcacctggcagaaacttacttggcaggagctcacctggcaagatctgtcctggctggacctcacttcactggacctcacctggcaggatctctcctggcagggcctcacctggctggatctcaggcgcttgctctccagccccgtcttctcctgcatcagggcctccttcttggccaggatggcctcccgcttgtggagctcctcccccagctcctccagcgcccgccgctgctgtagcaccttctccatctcctggtccagccacttcttctgctcctcaatcttctaaggaaaagtagggagggagggagggaactcagggcccacctctggctgtgtcagccgccactcgaggttcactggggagaaaggtgcacccaccagccagcccccaggggagccctgggtgcggacacagcctggccccacctgctgctgttccaggctgaccacagagccgttgctgccactgcgcctcttcctctggaatgccgcgatctcttccgtcttaatcttcaggatcttctgctgttgctcatgcttcagctccagctcctgggtgaggagctcagtgggcagggctgtttatggtgccagcatcttaccagagcctgccaccgatcccaaagcccccaggagtgcctgcccactcccaagagggccctgcgaagtgtcccccagacccatcccacacaaatctccctggagaccggcaaatagacgcaaacacttagaaataagccccacaagatgccagtcacctcatatacctcatctcactgaagtctcaccctggccttgagtttcctataacattccacattttcagatgaaaaaacagactcaggctaagtgacctgctttctaaggtcacgtggctgtgggttgcaaaccctgcctgggctcccctggctgggccgccagctcagcctattggcctggacagaaggtccccaccctgccgtgagcctgaccttgacgcggtgctgccgcttgctcatttctgcctccaggcgccgcttctgctccgtctcctcgcgaagccgcctctgcagctgtccctgctgctgccgcatgagctgcacgttccgctcgagctcctgcagtcgcttctcactctgggccgacagtgacaccagccgctccgtagcctgcttcttctccttcagcacctgggacccacacagtcttcactgggccatgcacggggctaccgcgagcctgccatagtgctgggcactcaacaagggcaggcagatagagggcaaatgggtaggtgggtgatagaccaataataataacagaggccgggtgcggtggctcacgtctgtaatcccagcactttgagaggctgaggcgggcggattacttgaggtcaggagtttgagaccaacctggccaacatagtgaaatcctgtctctactaaaaatacaaaaattagctgggtttggtggtgggtgcctctaatcccagctactcaggaggctgaggcaggagaatcacttgaacccgggaggcagaggttgcagtgagccgggatcgtgccactgcactccagcttgggcaacacagcaagactctgactcaaaaaataataacaggacacaggagccaagatggccgaataggaacagctccagtctacagctcccagcgtgagtgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcactcgggaagtgcaaggggtcagggagttccctttcctagtcaaacgaaggggtgacagatggcacctggaaaatcgggtcactcccaccagaatactgcgcttttccgatgggcttaaaaaaggcacaccaggagattatatcccgcacatggctcagagggtcctacgcccacagagtctggctgattgctagcacagcagtcggagatcaaactgcaaggtggcagcgaggctgggggaggggtgcccaccattgcccaggcttgcttaggtaaacaaagcagctgggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagcacgcagctggagacctgagaacaggcagactgcctcctcaagtgggttcctgacccctgacctccgagcagcctaactgggaggcaccccccagcaggggcagactgacacctcacacggccgggtactccaacagacctgcagctgagggtcctgtatgttagaaggaaaactaacaaacagaaaggacatccacaccaaaaacccatctgtacatcaccatcatcaaagaccaaaagtagataaaaccacaaagatggggaaaaaacagagcagaaaaaatggaaactctaaaaagcggagcgcctctcctcctttaaaggaacgcagttcctcaccagcaacggaacaaagctggatggagaatgactttgacgagctgagagaagaaggcttcagatgatcaaattattccgagctatgggaggaaattcaaaccaaaggcaaagaagttaaaaactttgaaaaaagtttagaagaatgtataactagaataaccaatacagaggagtgcttaaaggagctgatggagctgaaaaccaaggctcgagaactacgtgaagaatgcagaagcctcaggagctgatgcgatcaactggaagaaagggtatcagtgatggaatatgaagtgaatgaaatgaagcgagaagggaagtttagagaaaaaagaataaaaagaaatgagcaaagcctccaagaaatatgggactatgtgaaaagaccaaatctacatttgactggtgtacctgaaagtgacggggagaatggaaccaagttggaaaacactctgcaggatattatccaggagaacttccccaatctagcaaggcaggccaacattcagattcaggaaataacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggtcaatattcaacattcttaaagaaaagaattttcaacccagaatttcatatccagccaaactaagcttcataagtgaaggagaaataaaatactttacagacaagcaaatgttgagagattttgtcacacccaggcctgccctaaaagagctcctgaaggaagcgctaaacatggaaaggaacaaccggtaccagccgctgcaaaatcatgccaaaatgtaaagaccatcgagactaggaagaaactgcatgaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggagcaattcaacaagaagagctaactatcctaaatatacatgcacccaatacaggagcacccagattcataaagcaagtcctgagtgacctacaaagagacttagactcccacacattaataatgggagactttaacaccccaatgtcaacattagacagatcaacaagacagaaagtcaacaaggatacccaggaattgaactcagctctgcaccaagcggacctaatagacacctacagaactctccaccccaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagaaaaaaagagagaagaatcaaatagatgcaataaaaaatgataaaggggatatcaccaccgatcccacagaaatacagactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaaaagtccaggaccaaatggattcacagccgaattctaccagaggtacaaggaggaactggtactattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaatcacgattatctcaatagatgcagaaaaggcctttgacaaaattcaacaactctcaataaattagatattgatgggacgtatctcaaaatcataagagctatctatgacaaacccacagccagtatcataatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacaaacagagagccaaatcatgagtggactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatagaaccaaaaaagagcctgcatcaccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccatttaggacataggcatgggcaaggacttcatgtctaaaacaccaaacgcaatggcaaccaaagccaaaatcgacaaatgggatctaattaaactaaagagcttctgcacagcaaaagaaactaccatcagagtgaacaggcaacctacaaaatgggagaaaatttctgcaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgcagctataaagacacatgcacatgtatgtttattgtggcattattcacaatagcaaagacttggaaccaacccaaatgtccaacaatgatagactggattaagaaaatgtggcacttatacaccatggaatactgtgcagccataaaaaatgatgagttcatgtcctttgtagggacatggatgaaactggaaatcatcattctcagtaaactatcacaagaacaaaaaaccaaacactgcatattctcactcacaggtgggggtggaacaatgagaacacatggacacaggaaggggaacatcacactctggggactgttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataataaattaaaaataataataataataacagtatactaataatggtaaatactacgacatttacgcaccaggcaccacactaagagctctgtgtatattaaatggtcctaatgagcctacaaaaagtgtaattatgattatccctattttacagatcagaaaactgaggcagagaggttaggaaacttgaccaacgacacatagctagtaagtggtagaactgggattcaaacctgagcagtcaggctccagagcccatgctctcaaccactccacgatattgtctcttggacatttgaactgagaaaataaggatgggtgggcatctgcaaggatggacggatggaagggtgggagggacagatggctaggtgggcgagatcatatgaaggtaaaaaaataggataggccaggcacagtggctcatgcctgcaatcccagaacttttgggaggccaagataagtggatcacctgaggtcaggagttcaagagcagcctggccaacatggtgaaacactgtctctacttaaaaaaaaaaaaaaaaagaaaaaaattagccaggtgtggtggcacctgcctgtagtggcaccccgctactcaggaggctgaggcataaggatcacttgaacccaggaggcggaggttgcagtaagctgagattgcaccacagcactccagcctgagcaacagagtgagactccgtctcaaaaaataaaaaatgaaaacaacaggatggagaccgtgatgggctgaattgtgtttccccaaaattcctatatgaaagccctaaccaccagcacctcagaatatgactgcgtttgtaaagaaggtctttagagaggtgattagtttaaatgaggacattagggtgggccctaatccagtatgaccagggtcctcatgacaagaggaagagataccagggctacaagcaggggaaaggccgtgtcaagacacagccaggaagtggccgtctgcacaccaagaagtgaggcctcaggggaaaccagacctgtagacaccttgagctcggactgacagcctccagagctgggagaaactaaacttctgctgtttaaatccccctagtctacggaagtttgctatggcagctgtagcaaactaagacagagaatgcatgaattaacaaaaggggatggaaggggtggatgcacctgtggataaatggacaggtggtcaatccactgataaaaggctaaaccagctaggcgtggtggctcacacctataatcccagcactttggtaggcccaggtgggcggatcacttgaggtcaggagttcaagaccagcctggctaacatggagaaaccccgtctttactaaaaatacaaaatcagctgggcgtggtggcacgtgtctgtaatcccagctactcaggaggctgagacaggagaatcacttgaacccaggaggcggaggttgcagtgagccaggatggtggcactgtactccagcctgggcaacagagtgagactctgtctcaaagaaagactaaaccgatggcatgggtttgacggacacatggaccaacggatagacagacaagggagaatgggatggaggggtaagcgaatggagagctgaaagggggaccgggagacagaggactgcacgctgcagggtaggtttctttagacgcccacccttcaccctctcgttgctctcccaggtggtcttcaggcaggacctgccccctgcctctactgtgtgtaaagctgggcggacccccagcttctataccagcctcaccctgcagggccagggctggagcacaaggttccacagtgaacttgggcctcagagcccacatgtcctggtcccaaggatggcagcctaggaggcaggagtcaccccagcaccccaccctgaggccccgagactaacctgcacctggctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctggcggttcagggcctgagctgcctttcctggaagaaagcgggaatgtcagcacaggcagccctgctccaccgagagggccagctgtttgtccccctgggaggtttcccagcccttggacacctgtgtgggtttcaccaagcctttgcaccaccagtaccacagtttacttaatatttttcttcaaatcaactctatttatttatttattgagacggagtttgctctttttgcccaggctggagtgcagtggcgcaatcttggctcagtgcaacctccgccttccagattcaagtgattctgctgcctcagcctcccaagtagctgggattacaggcacgtgccactacacctggctaattttgtatttttagtagagattgggttttgccatgttggccaggctggtctcgaactcctgacctctggtgatccacccaccttggcctcccaaagtcctgggattacaggcgtgagccaccgcgcccagcctcaactcaccttttaaataagcctcatccactgcagcgacccaaggaaattacaaattagttttatttttaccaaatgcattctaaaataaatatgtaacctgaacctgtatataattaagcctttagaactaactttcatttccaggaaatctggaggacaaaagaatgagctaaatgacaccacaaaaaagcaaacagacaaaccccaaacgtggggtttgggacattcagcaggatgactgagagaagggagatgtcagagacctcagaaacaaatacagtcggccctctgcatctgtgggttccacacccatgggttcaaccaaccatggatggaaattatatttttctaaataaatggctgcatgtgtactgaccatttacagatttttcttatcatcattacctaaacaatacagtaaaacaactatttacccagcttttacattgtattaggtattgtaagaaatctagagatgatttaaagtgatttaaaggaagatgtgggtcagttactgtaaatactataccacattatttactaaaccttttttgagcatccacagattttggcattcacggggtcctggaaccaatcccacatagatatcaagtgacgactgtatgatgtgtgtgtggaacaaatgtggagcctgattcaagcgatccagctataaacagacactgctgataatggagagaatgtgcttatgctctggtcattaagaggactgtgccgggtgcggtggctcacgcctctaatcccagtactttgggaggctgaggtgagcggatcacgaggtcaagagatcgagaccatcctggccaacatggtgaaaccccgtctctactaaaaatacaaaaattagctggttgtgttggcacacgcctgtagtcccagctactcgagaggctgaagcaggagaatcacttgaactcgggaggcagaggttgcagtgagccaacatcgtgccactgcactccagcttggcaacagagtgagactccgtctcagaaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatataaacgctccactggccagcacctaaaactaccccgtgtcccctccttcactcatatcaccagtcataggcataacacaatttggagacgctcagtcctccatgacactcactgtgtgctccccaggactgagagatacttcgcccagcacaatggctgaaacattgcaggcactcgataagtaagaagaagtgccgggcatggtggctcacgcctgtaatcccagcacttgtggacactgaggcgggtggatcacctgaggtcaggagttcaacaccagcctggccaacatggtgaaaccccatctcaactaaaaatacaaaaaaaaaaaaaaattaggtgggtgtggtggcgggcgcctgtaatcccagctactcgggaggctgaggcaggagaatcgcttgaacccgggaggcagaggttgcagtgagccaagatcacgccactgcactccagcctgggtgacgagtgaaactctttctcaaaaaaagaaaaagaagaaaaaagaagtactgcttactaagagctattctaagcacttcacctgaattaactcacttcaccctcacaacacccctattcagtaggtataacgactatccccattttagagatgaaaaaactgaggcacggagggtttatgctacttgctcagggtcacacagctggaagaggctgggctgagtatcaaacctaggccatccggcccctgctcctaaccacctcattgttgaaatccctctagaacagtgcagaagtaacgatgagaagtccccctcgggtgagaggcccacctgatgcccacgcctcacctgtgcggaccagctcgccaataagctcctccttcatgcggatgttgatagccagctcccggatcttctgctgggcctgggccagccgccactctgaggctgtggcaggggggacctggcgggcctgaactcgggccttgctcccaccaactgctgcaacaggcagcctgtcaaggttgctgccccaactgacagtgggggagacagaggagtggagagcaggggctgccagggatggtgggtgggactgtcccaaggtggctggcccagaaccgtggaggggcagtggggaggaggccctctctgcatcccacccagcttacctctggaccctggaatggctgcatccaactcctcaaggcaaagctctgggcccttcctctctggcagactccctgggcgtgcccccgccctctgactgcagttgctgatcctatttctggaggacagaagcaggaggccatgctcctccccagcccctgccccagcctagccacccccaggcctggagggaagaagagaggccaccgggtcttccacctcccagggtcaatataaacccaggatgtgagtctggcagaatcaggagtccaggggcagagttttaggaggtacagggcagctgggggcatagagggccaccctggaggctgaagtcaggaggcctgggcccaccttgtatcacactcgctccagtgagacctttcggctcagtgccccacagctctcccccaggggctggccagggcaacatgagggcatcctaggacccagaggcttccccactgctgtcaggagaggagacggtgcgatccccagcctgcctagccctgggccctgagcaggtccttgtcaggtgggggcagtgggtcccactcacctgcgcaggtgtaaggtccgcctgggcggctcctcctcctcctcttcctcctctgaagcagctgaagagccacttcccagcctgttcacctcagtcagcaactcagctccagcctccctgccatttgtcacctgctaggggagtgagccatttcccatcccaagtcatcatccctgcgatataccccaccttgcctgccctcctcatatctctccctcctcaagccctgccttaccttcgtgatccagctcaaatgacccctctggcagccttctgaatctcaagctggggtgagagcttcctccctcccctcccctcccgcctgctttggctcccatgatacctggtactcctcaggtgacaatctgccctttctaccttgtgtacaggtcatgtgcacccaagtcctatctcaccaccaattccctgccagagtgatgggtgaacatgagacttctgccaacccccagctttgagagctgagatgacccaggcctaaaagccccagaggacccagaactttcaggcaggagtaacctttgtccaaacaaggttccccacgtggaaaagtgaacttgcaaagagagccatccaaagacagagggggtggtctgaaaggtgatgagctctccgtatgcagaagtgtgcaaggtttccacccgatgccggaagcctgaaccccctctgtaacctcctcattccaagcgatcttcagctaccccagggatgcccgatggcactgcacccttctgagaggcccagagtcattcaaatcttggctcttcctctggggacagctgaaagcagcctctcgcatctcacagccagtcccatgaaagcatgagtgggggacacgtgccccagtgcccccttcccctgccccgaacttgaccagtccagcagggcccacagacacccagcctcaccctcttctcacctctcccctctgctcagagccaacttcatctccagggaggcaggcaggcggcaccatgcccagcacatgggcgtgggcaccccccaggggggctgtatgaggtcgaggcacaaaggacccgggaggcaggccattcaggagccgcgggcccccccagcctggccgcaccagctctaaccgcagccgcagttccaccatctcctcctgctgctcacgcagccggtcgctctgcaagacatggtccaggtgccaagggggcatgaatgccccgacaggcaggagtgtaggaaactgaggaacaggtctgaggccactccaccgtctctgggctgaaaatgaggagtgtcaaatactcctctcctccccaacaactctgtaggagttcagactcaaactcaccccacagatcccatcacactcctatcctgccagaccgccacctccaaccgccgccaccagagggcgccaggagcaatgctgacctggtgacgcccggctccaaggtcccccgctgctgcccctcctgtcccctctcccgtccaagctcacaccacccagcaaagctgccctgcctggcggtcctgcacacccacctgcgctgttgtgatgctcacctccacactttcgctcatgtgcacctcctgactctacacccctaccccgcagtaccctaccctaactccctcccatcctgagaaactcagctctgccttcccttcatcctcctctgggaagccttccccgcactgtgaagcgggcgccgcacctgcagtttgtactgctccatggcgtcctccagcgcagccagaaagtctcggttctcctcctccagccgcgccacctggttctgcagggtcagcagctgctgcgccccctcatcctcctatagggcagggagaggggcttcaggggcgggggttgacagggcgagctggacacccggcctcttcttgtttagccctgctttctatctactcttccaagccctacctgcagtgggaactccagacccactggtgggaggaaaccccagaccccagctggcctgggtgccctctgcaagccatttgggtcatctcttgtaattatccatcgtatttgtattaataatatcaccactattattaggaacaatttactgcgtcttcaccggcatgctaggcacatgtgacaccctcagcccttacaacatccccactaagagatggggtaagtcctacggttatccctattttacagctggagacctgagactcggtgaagttaaggaagtgaccacggtaatcagcagaagtgaccgaatcccgaacgtgccctgctaatgggcaggaggcaggggcgcagctgctgtctgaagaccctcttccttcctctccaccactccccactgcccacaaccacaaccacaacctgtccctcggccacctttcgcccgccggccccctgcgccgcctggtcctcgacggaggcgctctcgatgccgctatcgggcccggaggcggagctcagggcgctgcgctcgccctcgacggcgcacagccagtcgcgcaccttgcgggcggcggcgccgggcagcccgggctcggcctgcagctcgcgcaagaggctgtaggcggcgtcggtgcaggcccggtagcgcgcgcactcggcgcccaggcgcatggcggccgccgcggaggcggtggctgggcctggggcgcgccggccgcggtggatgatgcgggtctcggagcggtgccgtggcggaccccgcgcgccgctcgccgtctcttcgggtggccgctcggcctcgggccgccagttgaccgtggcgcggttgcggatgttctgggcgcggctggcgtagttgagggtgttgagggtctcgtcgaagtcggaggaggaagggctgacgcaggcgatcatcaccgtcttggcgttcccgcccagcgagtctttgaggatcctgagggcgcgagggggaggctctcaggggccccgacgctccaggcccagggccagcgggccagacctgggaccggctcctggcgcggttcccgtgggctggagacctcaggggacctgggcttccacccccactggtgtgctggacactccccgcctccccggcccccaggccacataggagccagggggcagctcaccgggtgatcttggagtcgcggtagggtatgtggctgccccggcgctgagggtcccccagggcgctgatgacgttgcccagcgccaggaggctgctgttgatctggatgctctccttgagccgctcgccggtgctgcccgtcttgagcaccctctctgagcccgccaggtccacgaagtggaacttggagacgagcagctggcccggggcggggcggggtaggcggctgggggcgcgcccccgctgctccagggtcacggtgaagaccgtgtgtgagcggctagacaggtggttgaggtgcgtggctcccgtgtgccgcgccgcgttgcccatctccaggaggctcagcacctcatccaggccctccacgtcgacctccttcaccccgcacagcactgcgggcacagaaggccgtgagccccagggcaggggccgccagactgaccagccaggagggcaggcagagcagaactagccccaaacctgcccttcctgacccactgctccctccccatgcccacggggtactgcccttcctagttccggcttgaggggctccggcttcccactggcccacctcagtgcctctcactctgggtatagaagcatgtactgaactcagtggaggcaagaagctaaagcaaaacctcccagggcttgggttttccatgaggagttgccattcccagacaggtaagcactccactccaaacaggtgaagcccccctaagcccctctccgtcagtggaggaccccagagttcctcaccaacattcccgcgctcatcttcccggagctggatgtcacggctggcagtgcccacctcgagcaggtctcggaactcctccttgtacacttccaggtaggacacatgtaccagacagtcaagcaggtcgttctcatcgatgagcttgaaggcctcggccatggccctcgggacaatgccctgctcatcctcaaggagggaggctggggagacaccgcagggcctcctgccacttcagctggacacggcccatggcccccaggcccggaagctcataggcccctgccagagctggaggatggtgctctaggatggagaaggcagtggccgaggccaggatgggacaggtggcctgagcttggccatgctccagcgtggtcaggcagaattataaaatttaagagttggaagcaacctctcctgattcaatcaacccctttcatgctgtaagcatccccttcactgcatcctcaacagattatcaaataaccttgccttgattactcctaatccatgctcagttatctaaagggcctcctaaatttatcccaaggaaataatcagaggaacttcagagcagcactcttcctcatgacttcaaaaaatgcaaacatcctaagtgtccatccgaagatccaataggagatctggccaaatcaactttttttttttgagactgagttttgctctcgttgcccaagctggagggcagtggcgtgatctcggctcattgcaacctccaccttccggtttcaagcgcttctcctgcctcagcctcctgagtagctgggattataggcatctgccaccatgcccagctaatttttgtattgttagtagagatggtgtttcaccatgttggccaggccggtctcaaactcctgacctcgtgatccgccggcctcagcctcccaaagtgctgggattacaggcatgagccaccgcacctaaccaactattttatattcacaatggaatgccaggtagccattaaaaagttagatttttttttttttggtagagacagggtcttgctgtgttgcccaggctggtctcccaactcctatgcccaagcagtcctcccagctcagcctcccaaagtgatgggattacatgtgtgagcccctgcgcctggcctaaaaagttagattgaagaatatttcatgatacagagaaatgttcatgatacatttgttgttgttgttgtgtttttgaaatggcatctcactgttgcccaggctggaatgcagtgaagcaatcttggctcactgcaacttctgcctcctgggttcaagcaatcctcctgcctcagcctcctgagtagctgggattatagacccccaccaccatgcttggccagttttttgtttgtttgtttttgagacggagtcttgctctgtcaccaggctggagtgcggtggccagatctcggctcactgcaacctctgcctcccaggttcaagcgattcccctgcctcagcctcccaagtagctgggactacaggcatgcaccaccacgcccagctaattttttgtattttagtagagacagggtttcaccatgttggccaggatggtcttgatctcctgacctcatgatctgcccacctcggcctcccaaagtgctgggattacaggtgtgagccaccacgcccggctcagtttttgtatttttagtagagatggggttttgccatgttggctaggctggtctcgaactcctgacctcaggtgatctgcctgcctccgcctcccaaagtgctgggattacaggcgtgagccactgtgcctggccaatgatacattattaagaaaatcaaacaggacacaaaagaatgtatataatataatcccatttttgaaaagtaaaataatcttcccagggaaagaaactggaaggctaacagggcaggggatttccgaaaggcaattatcaagtacattttatttcgtgcatgtgttttgctgtattttcctaattttttttacacaaagtatctttctgtaactgctatggtctgaatttgtttatgctccccaaaattcacatgtagaaatccttacctccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaaggatctttctcgaaactgctccagagcctggctgaagcaccctgcagccctgctgtgcagtatccaaagcagcctcttccaggacacacggcccccattcccaactgctccagctagaacagattcctgaccttccctagccagcctgacaacctctagagacacgccaccttcccgtgcccttcctctgctgaggtccccagagccaggcagcatggcgccatctctatggaggtgagaaggccactcacctccaacgacccttccttcctgccctgcctagcccacagacatggctggtcccagcctgggccacagatccctgtctaggaaatcgactcttcctcccccagcatccccaccttccacagaacaggcagcaagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccag

SEQ ID NO: 440 - DNA, 27845 bp, Homo sapiens
attaccaggtcaaaatttttattcgttcattcatttattcatttgttctgcctgtgcaaggcagcctcactcccaggctgtcagcaggactttttttttctcttttgtacagatctggttcttggctttgctccttgactcagttgacctcctacccctcacagcagggtaaagacttgcacatcactgacaggcggctcggagtcagccttggagtcggccttccatgcccagccctgaggccaccatgccacgttccagttggctcaagcagtgaggggcaaaaccagctccagggccaggtggaagggctgcttctctcctgcctccatcaaatgctgaccttgcctctgaatgaccaagcaaaacaaaggaataaatgaatgaataaaaattttgacctgttaattccttaagaccttgatacgtattcgtgggtaagcaattttatactattttataaaactgttttcagctgttttagtcagggtcgggtgccaggcacctagacacccccctccccattcccaggaaggttttggccaaacctgcatccaccaccttggcatgccaacgcattcgaggccctggcaggccccgactcaacagaaccgtctcgccctctacagccaccacagccacgtgggccaatacccagcacgcgccccactgccccaagcctctctgccggcgtggctctcccccaacctcactctcaatacaaaagggacagcaccgaaagaacaagggaggccggaatggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgag

SEQ ID NO: 441 - DNA, 27845 bp, Homo sapiens; identical to SEQ ID NO: 440

SEQ ID NO: 442 - DNA, 121585 bp, Homo sapiens
ggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcagttatttttctcttttgtgtgaacttgaagtgggtgttgtgaaacacccatttttcctttccaggccttgtggagtctctgggtgaagatatcagctgggaaagggttaatgagctatcaactcaagtcatcatacatctggatgggctgtcattaacttcttacaaaaatttgatttcccctgagagatttttcatcaaacatttatataacccagaaatggccaggggagtccagcgtggccacagaactcatcagaagccatggaaagcctgctttgtccccactgtgagcaaaataatgtgcttcctgtacttactgggattcttcttggaacaggatgaaatattcaaatctcatttacctaaccttgccagatattgcttcttcgctgaaggctcggtttctggctgtttcccctacaggtatatagatagtcaagactctggagaacctcttccgaatctgcctggttggctagaggtgtagaggagccaggggcacattgtgactcagaccctcactcattggcacaaagaagctacagaatagttatataaacagaggcagtgtgccagcctgggaaaactcccagcctccctttggccatagagtaagcaaaacaaatggcttcactggccccatctacccacttgacttaggtcagtattcagcctaaatgttttatttcctgagaggctggaatctgtatttgtggtatcaatcagtcaactgaaatttattaaatgcctgctgtgagcaaggcctaatgctgagggatgtaaagaagagtgagaagctagtctggttggggtgatatgacatggcaagtcatagaatgaagaagcgtattccttgtcatatgaaagctgtagattagtgtgtttctaagtagaggccagggtcactggagtctaggattgcagggttggctggcttcccagaggctaagaatttaatctggatcttgaagatctggtccaattccaacaggtgagaggcataggaaacatttaaggaaaaggacattctgggagctgaagggcagaggtcagtggatttggagctatattagtatttttttaaagtgtctacatggtaccaaatatctgtaaatatattgcctgttagcctacaacaaactgtgtggctggtgttatcctcatttgaggcccagaaggattaagtagcttgcttatggccatatagctgatttgaagactaatactctaccctaaacagagagtatttcattggattagagcagatgaatctgaagaagaaaataaagggagttgatgttggatgggtagattgaagacagattacagtttgttctggctattgaaccttgctcaaattatttaacttcactgaacctcagctttcaagcctggaaaattaagattataccaacctcattggggttattatgaggattaaaatgtagaatgtatataaagcacttagcacatggactgacgtatagtaagcatacttagtgaaatagaagcattttttaaatttcaaaactgaggaaggtggattttaccttggggaaaaaaaatgagaggtattttaggttcttcaacaggaaagtgccataattaaagtcacagtttaggacagtgaagcagacggtgagggtatgaataggggtagaggtagtaagaatggagaggaaagggaaattaccaaaaacaggtaaaagttttttgaagggtaacttttctctcccagattctaccccctgcccacaccccctccacccacactcatacactctgtgggccgtgttacttctgttcattagacttataggcatagagctcatcaacagggtctacatagagctagtcaggaaggtttacaggttcaagggcagcctggtgagaccagcagcatctcccagagagcccatgcccgtgcagagtcctaatgagccgcttttgtctagcttccatttgctcttccctcccaactgaatttaatgtctttccatcctctgcctctagttaagttgtaactgctgttattccactgcagccaggcagctgccagggcctgttggcactgaacccagagcccaacccaactgatgttctcactgagcttcttgtcagatgccaggaaagaggaggcacatcatatgccttttcttccccaatagtagctgcttccaatgtgatcatgatgagaggaaaaggctgtggggagagttaatttgatgcttgcttgtgcaatgaaatggcaatcaggcagatggccttactctatgcatagattcttctttgaggtttcttctcaggacccggacctcagagctgcttaagcaatagagaagatgatggatggccaaggaattgggatctctgggtcttttgggagggatggggaatattatcacagagttacagaatgccattgctgaagagggccttagggattacatttagtccaaggattttcagacttttctctaacagaagaattctttcttcaaaccaaaccttacatagaatccctaaatattaaatagaaaaaagagcagggttggcttggttgaaggaggaatagaagactccaagtcctagtagttgggttgtccttttactcacttctcaagggcagcttcagtgccagctctggtctactgcttgaaagccactagcctggccaaatctgttcattttactatggaagaaacaggtccagagaaggggagtggcttttccaaggttgcttgattctgcgccagtgctttttttatacagttgcctctttttgcattttgttgtaaaaaatcagaatcctttacatggcatgaatttttccagtaacacttttgcgtagagctttttagtcttataaatgctatttctgtagtgcaggggcatctgttgtcagatgccaggaaggaggaggcatgtcagaaaccctagtctgcagctaaggcctgtcctaggatgttgggcattggtggggatgatgacccacagagtcagctccccattctctccttctcccatctagagttgagcttgcatacattagctgctgttgcaatactcctgctttcagaaccctgaaatggcctggcttggttgctatatagtgatttaaccacagtaaccctcagtgagtggcaggttgtatttttattgttgaattttgttataatgacaaccccagataaacctgaaaatgaaagaggattctctttaactctcaattcttctcatgtttatgaagtagcgcttaattaaataatgtcattttatccttatgaatcttcttcctcctaaccgcctcacagccctctagggtgtgtttaactgttgaattgggagtcaagaactgagaactctcacccagaccttggaagtcggaatgtcagccctctttctactgcacagccaagcctattgatgtggtcagatctgccctctggaccaccttccttttctgccaagccttggggctgtccatggtgtgctcatgtgccttctccttcccacagcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggacttgtctagattaattacacagaaggcacattattctggggtgggagaggcctgggcccggctttttgtcaggtgggtgaggcacattccacttattgagcaaacagttagtgagtgcctgctgtcagacactcgggcttgggtgcagacatgggggattaaagccctcagggagcttacagtctggggaataaggtcgctaaggcttgaggagggttcaaactatgcatagagaggggtatccaaaggggcccagcaggatcaaagaaggtgaaaaacagcaggtatattctaaaaactaccaacagttcaggatggtgaaaggaaagtgagggaggggggcgctcccagtggtgaggctagaagaaatgagagctgaggtggggccacatcctagaggctttagtggggaagcgagggctaggcagggaatgctgtgatcttttggcatttggcagagttctgaataatcttattctcctgaaattagaagactgtgatgaagtgtatagtttgggtattgaataaaaaagaatgggtacctgcaggaaggaaaggagctaagatgctatcccaaaggcctgatgctggttgcccagacaggggagcatgaacatgggggccttgttttggactcttagcctccagtgactagaataaaaagggcctaaaaaagctaaagtgagaggcaggagaagctcctcggttttcattgttctgaatcttttggttccacttgtgtggttgtgtgtacaagtcagagtgaacctcattcctgtggataagagccaccatttctcctactggtgaaattagaaggaggttgtatagggcttatgcaatagaaaagatcaagatggacctttgggtatagttggctttaggaggaggaattttaccaagatactgttttgctgtctctgtactacttcctgtgtgttaactccattctcagacaggccattctcccatggaggcaaggtgactgcatttccagccttccctggtaggttgaaatctagtggaaagagtctctgcctccctcctcaaagcccccataaagtttgtgtgtctcattggttttgattgggtaaagtgcttatgcctgggtccatgcaaagcacgtggcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcctggggaaaatcaaaccatttacagttcatttccattgctgtggcttaggaaatgtcagtgtctgaacagatggagaagtgagatggcagcatgtgcaattagaattgggggaaggggtgtcaccaagcctcaggaagccccattcctcacctgccctggcttctggtcaaacttgccttccaagcaccttctccagctgtcactgaggttccttcccagggatcagtggaacttggggaccagctgagtggagtgatacattttctggtgttagtgactgagttgccttctgagccaaacagcttgtctccataaaggaggaatccagatgctgggtgctcaagccccctcctccccctgtcagagccttatttccatactccagagtgcagctgaagtgtattaccttgcaccctggtagcggaccactgccaaagcatgcatcatcatcagctctgctacttcttaaaggaacaggcttggaggtggtttttccctccatgattcctctctgctaggtctgggttactttaaaaatcaatagctcactcttctgccagggccctccctttatgtaatatagctgatcagtggctgagccaggcaggggccaggaccagtcctggagcttgtgaaggttccgcattctagcctagccttcatatgagtgaaaataaaaagagatgagagggtgggtcattcttggcctctgcagccagtctatccccatcagtgtgggttgtctgcagattgtggaggcaacaggagggagctgcctggaagtcgttgaactagggccaaagattgggtagcattttgaccggaagccttaaaattggccagggtcccacactaactggtgttctggggtgcacagcacatgaattgatgccaagtgctctcagatgtactaggaggaggtgcttggctccatttttggtgccctcagaggctgtgggactctggatgcctgactggtgacatcaggcagccagagaatttcactcttggcgctaaccggttctggccactgagctttctccattgtgtctgcttatccaagagttagagtgaagtcagctctctgtggatctgagagttggctcaggccagcctctcagctgggggaagaggtcaagtcagttgggagcttaaaagccaatggaggaaaaggtcaagtcccagccccctccatttgaagaaaggttttttcttttcaagcaagggaatggtccgtgggcatgtgaatgtgcccactctttgctgaggaggaaggagaccatttctatccagatgtctctctgcagacaagaggctaaaggacgaacggtaacaaggtgacaggagctgtctccacatgggtcctgcctcccaactctctcagccttctgctcctcatctgtcatccaggggactgtggatgacctcatcccataaccacatctccaatgggagacagtggaacagccattccttcacacaggggaaagctaattggcaataatccttgcgggaaggtcagactcctctcttacagatctagggaaggcctggggtaaaatgatggctctttggaaaatgccaagctccttcagattccataccccctcgggccctctagcataggcaacgaacttgttcctggcttcacgctttctcattgaatcaaagctctcatgcatggcctggatttgtaaacacatgctggctgccagcagtggcaagttagcctcctgacccacttctctcctgctttcactctggtgtatgaagggggatgagggaggggccagagaggtggccacttggacctttggcaggaaatcttcactgtgccaaagcattgtgtttctggagccggagctgcctgaggcactcttctccagcctcctcagccttccatggagctgcagaccctacatagacctacccctgccgggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtgagtttcttccttaggaggctcaaagccacactcttagtttccctgttgaaacttttgctgctgcccgtctgggagcaggtggaaggagcatgcagagaatgtccgggcggccgcaaacatttcctagccaaatgtaggcttggactttccccctctgctacatcctgcccttgaactccaggaagttgctcttgcattgccaaaggttgtgctctattttgagcttttgcgaaatgctttttttcccctctacacatttaatcaaaatggcacttggcagctgtgtgaacaatattgtgtctctgaaaccacctcctcatgcctagctttttccagcatgttcaaacaaacagaggcctttgactttgacacttcaaacatctccatcctcttaggaaagggtgagtttcttctgggctcagtgtatttgctttcaaaaagcggttcaaaagggcgggtgatccagctttctgttgagctcagatggcttcttaccttgtgtctcagtaagtcttactttctgcaggaagatcaggaagaagtagggataggtcacttagtttgcaaatgagcaaacaagttcatcagtttgttgaaggtcatgaaacagaacctggggctttgcagtactaggcccatcacacattttaattagctgtttgtatgagggggttggtttagatttattttattctctttcccttaaaacttctattataatgttgttatataatattataataatgctaatattaaattttaaaagtaaacattaaaagatctgggtcaagtacatagcatgaagggttgtagtggcttttaggttttcactgtagagagtagcatgctgtagcagagtccatgtgatgtttacctcccacttagcactgtccagtgggaagcagagctgcacactctgatggcatcctgtggccttccccagcccactctcttcaagcttctccatcacctgctgtttaacaacccacccttcatgcatcctgttggcccttgtcgtggcaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaaggaaaaagaaggaaataaaaattttccataattctaccagctagagataatggtgttagaatatattcctttctaatctgttttctatgcatgcacaaacacatatgtgagcacatatttataattttattctaaaaaataggatactgctgtacatattgttttacaatctaagtcatataattataatattctttaagcatatttatgagtaaaatattaaaacctatacaaaaaaataatagaatggcattttagctcattcattgatttttgtaaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactgcttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgttttctaaattgacctttagtaaaagcaggaatggccatattcaaactggtaacctcgcaaatcctgcccaccctttcactttctgtctcaatacattgatgtcctctaacccatttcctgtcttatgtggctctagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacagcttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaagcgggtgggtctcttgaggccaggagttcaagaccagcctggacaacatggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaagaaagattaaaaaataaataaatctgctgggcgtggtggctcacgcctgtaatcccagcactttgggaggccgaggcgggcggatcacctgaggtcgggagtttgagaccagcctgatcaacatggagaaacctcgtctctactaaaaacacaaaaaaattagctgggcgtggtggcgcatgcctgtaatcccagctactcaggaggctgaggcaggagaatcacttgaacccgggaagcggaggttgcagtgagccgagatcgtgccattgcactccagcctggggcaacaagagtgaaactccatctcaatcgatcaatcaatcaatcagtaaatccagagaggatgggtagctcacaaaagctggacccaccactctggttacagggtctctggccacaggctgcttctctacaccctgtggaagaagcagaggtgaagggaagggctcaggaacagctcagcaatttttgcctcttatttgccctcagtggtgacatgtttcctgatcttcttggctttgtgtttatcgcttatcttttataacacatagttcatcaatgtctactttttacccgttgccttttttattgtgattgttaaaaatcaatacttttaaaagatgcaaagatttgaaaagggtatacaggaaaacgtactataaagtttcttttcattcctgactcctatttcccctcccctctgctggtgattgaaaccagtttcttctgtgtccttccagagatactctatgcatggacaacaactgacgtatctgtaaataccctttaatatgataaattacattagaaatgtaatgaaagaaaatggaagtagatatagaagtattccacttatacagttcttcacttttttaacgttctttatcttggatcttatttttatgttagtcccaaaagatctgcgtcctttttaaatggctggatagaattccactgtatgaatgtgccatcatttgtttaacaaattccctcctcataggcagtgatgctcgctgtttagccaaggtttaccaaagctttataaggctggcattttcctaagtatttcctttgttttttggaaaccaagcctcggctcttgttgcccaggctggagtgcaatggtgcaatctgggctcactgcaacctccacctctcaggttcaagcagttctcctgcctcagcctcccaagtagctgggattgcaggcacacgccaccacgcctggctaattttttgtatttttagtagagacggggtttcactatgttggccaggctggtctcaaactcctgacctcgtgatccgcccaccttggcctcccaaagtgctgggattacaggcgtgagccaccatgcccagcctaagtatttccttttatagggagttggagaattaggttcttttatgggggatagaacagtgaaggggttaaggatcatggccgataaagtaacaaagctaaacagtctgaattcttagggacaggtttggggaaggtaataggagaggaggcaatgccttggccactggggcactgagtgacactagacttggaacttgtggtctgagatctttttatcttggtattctcttgcaggcccttggtaaacgtgtgctagtgagtacaaatgagtgaatgcccctgtgctgtcaattaaactggggagacatgctccatttaaagtttactctattatgtattctatctgacagctgtttcctattttaaaaattgacggggaggaggggaaatgtcagcatgcctgcatggtggggaaacagccactatagtgacatctgtgtatctctgagcatgggctgggtaggtgtactcactcctcctgccttgctgcagtggatacttagggtcttgggttcacgcagattaaatccaaggcataagcaacatccagtgagttttatacccccatggtaagagtgtatttaaagggaagaggtttttaaaaatgaaatttgaaaagcattctagtgcctcttactacttttttaaggcccaaaaccttctgctttcattctgcttttattttagcacaaagcaaagatgcttagggaagggatgcttttaggttcactgaggaggtgattcaggtataaaggaacacctttctgagtgcctgctctatgccaggccctgtgctattaacagtaatgcttattatccaatttcattctcaccaactttgtgaaaaaaatagtattctcatttttcggatggaaaaactaagactcagggggttaaatgatttgcccaaggttaggagagttagtaagtggtaggactagaatattccaactcatgctttttcattttaatgcaactaaaacgtctatcaaggagggaatgtgcagaaagaaaagttattatgttaatacttttcaataaacaaaactcactgctgacagttaatatccaattaggaattattaggaaatcaattaatgagatcataaaaactgaattgaagtttcacaatggcactaaacaaaatgcccaatagactctttgcctcccttcctactttttgaagaaattctcagttttgattattttaagtgtgaaagttgttgggggtgggcactggtcagactgtgttttaggaacttgattttattttggtgaatacctagaataaaatattacctgttcttttgctccttcattgaggaaaaccccaggtagccactttgattttgggtgtttggtgaaggaaggaaaaagaactacctaatattggaacatgccctaagtaaggagagtgatcctcattgcccaaggaagggattttgagattggagattataagcagcccttttcctggcccccctgatctccagaagtcattaaaagccacctattcttcccttgcattcttcagcggtctcagctcctttctctgtgttgtctgtccaacagcaacagaaaccttctaactcacttccaccaattaaagacaaggtcacttatccccaacgagtctctcatatggataagtgctgacttgtgggtgggataggggagtgataaataaaataacgtgcctgcagactctgagatgcctttacctttccatacctggcttacctggatggaaaactcccaactgtggtttccacgccagtattagggatacagttcataccttgacacagttatgatccttcaggatttaatgaaacccgaagaggtaatccatcatacatctttaccagattgttatttattttaatggttcatcaagtgatagccagagttaactaatgaattgtgaacatgaatttaaaaaatgatttctggaatcacaagtagtgagaggaaggaatttgtatccatctcctttgagaactgtggctgttttctgagcagtctggtcttgttttgaaggttacagcttcttggtgaattttcctcattaggaaacctttagagtctcctgggataaccttccaaagagagaggcttttgaggcttgcattgttggcaatggatatttcctgaaggctttccacctctgggccctaaagtactgttccaaacccacaattaggcattggttggggatttggatattaccccgggaagaatgacagcaggtgagctggcatctggagcagatggaaaagggaaggtgataacagagcctctttccttgcagaagttcttgtgcaaaagcataaaaggacagagggaacagatcatgaataaggcagtagaaatgatttggtgtaagatttggttttggcttgttttatttttaatttagagagtacgggcacactaggggcttggtttgtaactgctgaggaagggtctacccagaggagagtgagactgctcattcatttattcatcatgcatttattgagtatctgctatctgctaggcgtggtagtatcagggatgcaaaggataatgaatgacatggtctctgaccatagagaggaggcagtctgaagaaaaagacacatgagtaataaaccctctgtgacagggctgtatgagaagtgctgtcatggagatttgcatggtacacacaggaccatctgggtgaacatgggagggctagggactgcatcccagagaaagcagatttttcttttgtttttaaacaagagagagaatcagatgcaagctcttagttaaaagttcacactgtacagaaaagtatagagtaaaagtaactcacatttgttcacttttcttttctttttctttcttttttttttttttttgagacagagtcttgctctgtcgctcaggctggagtgcagtggtgcaatcttggctcgctgcaagctccgcctcccaggttcaagcaattctcccgcctcagcctctcgagtagctgggattacaggcactcaccaccaccatgcccggctaatttttgtatttttttgttagagatggggtttcaccatgttggccaggctggtctcaaactcctgtcctcaagtgatccatctgtctcagcctccaaaagtgctgggattataggcctgagccactgcacctggctctgttcaccttctctttctatcactcttaatcctaagtggcaatccatgaaatcaaaggtttgatgtataattatatgttttacttaatatacattaaaagacagacagaactattaccatttaaaatggtgcatccacctatctacctcagtgatctcatatatcaccagtaattcacggatcacactttgggaaacctggccatttgacttctgagttcagacttaggcagatagcccctgatctggaggatgaaccactgcagcaggaggtgatcaaggcaaactaagacccccaagaaaggctgtggaggagagcggaaaagatactgtgttaaaagtccaaaggccttagattgggcctgacactaccacttgctagcttgcaatgatcagcaatttatttgatacctcccctcccctgagataatcttatctgtaataaggaaataatatcttccctatgtgccatacagttatttattgttagagtcgaatgagagaatatgcggtgaagtgctctaaaacctgctatgttgctgcatgcataaagcattaatactacaaaatttagttctgcttctctccttctcctgctctgtaccatgatggatggggcattttgtcgtaatggttaagagcacatgctgtattgtcaaactgcctgtatttggatactaactttaccactcactaactgtttgaccttgagcaacttaattaaactctcgaaacctcagtgctctcatgtgtaaaatggaaatgatgatgatgatgatagttcctagggttgttttgaagattcagtgaattgtctggggacatacggtctctcactgggcagacgagggttgagagagaacaaatctgaaagtgcagcacagcaatcatattttgactgtgagagcaggtgggatcacatttccaaaacttcatcttgtatttagacctggatgtgtgtatgcaagtcggggatgtcagccccttccgctgagtgctcagaaatccgaagctttccataaagactccatgcagaatagagaaggaagctgttgaggatatggctcaaagatgctccacatcctgggcttgcagctgaggcagggactgagcctgccattggcactgctcctggtgtgatggaatgtccccccctcctcccaccgaggggccagggcagggtgggatgtcagtggaggtgacagatagcaggtgtgtgtcctcacaccaagaagaccagggctcaataagttcatctaccctccctgctcttcctcagtgaaactgcaggagaggggctctaggaaacaatttctttatactggccatcatagaactcccagaaaaaacctggagaaggatattaatccaccatgaaaatcaacagctgcccatatgatcagtgccttaaagaaattaaaaaattgactggtggaaattgggtcagaaaccaaatgacctctatataggggaattgtccagctgagcatctgtgatttttttcttcttcttcaggagtctgattgctctttttcctcctcctctcttacagaaaatgaaagagtacctggagggcaggaacctcatcaccaagttacaagccaagcatgaccttctgcagaaaaccctgggagaaagtgagtgtgggaaccctctgctagaggcttgacagtgaggccagctggagctttcttgctgagcacacgcctccatcctcagccaagtggacccgatcttgttgtatgaatgcctttcttttcttggcttgttggatgtggaagcacacaccccaaatgactgcttgagtaatggggaaaggccaatgcttaatgaagcactaacgtgtatcatctagttgtttaaatggagcgtgcctgctctccacccagtccctccaccctcgcctcctctgccacgactagggtagagaggctgaggggttatttattctccagacactttgttaaaactcctagctcctctgaggcagcactgagactggagcaagaaggtagggagctgtgagatgagatacgcagctgctctgagaggagagaatcctcaaatgcaggagggatggacagactgctgctttctatagcttccagaaagagcatcagtttccttctgctttgaaagctcctaatgctgtttaagtggcagccctctctcgtgtggctatgctgaggccttggtgctgaatggactgtcttgtctcatagaatgattttaaccagaccctggaaagtagcaaggcagagaactggaccggcactctggactttctctcctcaactgtcaaacagaaggtggaggttgaaagagaagcttccccagggttttttggcaccctgcccagatttcctgcccaactctcagcatcctatgattaatgggattcccaggttggggatgcctctgaatgccgcccccccctccctgccccactaatctaatctcctcacttaaagataggagggagtggaagggagaagctgcagggaatatgtgctaacatcagttacaggcaagcctgtacttacacagagatctgacattttaaaataaattcttgagcactctttagacaaactgcaaagtttaggaaagtgtgcaatactccttggctcattggccccaggaattggagcctcacttcttattataccagaacctcctacccaccttttttgccctgtccttttcctgccttggatgatttcccagatgattaatttttttctctaatcttttatctaatgacttcttttttttttttttttttgagatggagtcttgctatgtcacccaggctggagtggagtggtgccatctcggctcactgccaactccacctcctagattaaagggattctcccacctcagcctccccagtaactgggattacaggcacgtgccaccacgcctgggtaagttttgtattttcagttgagatggggttttgccatgttggccaggctggtctcaatctcctgacctcaggtgatccacccacctcagcttcccaaagtgctgggattacaagcgtgagccaccatgcctggctgatcttatgactttttttttttttttttttttgagatggagtcttgctctgtcacccaggctggagtgcagtggtgtgatcttggcttattgcaaactccacctcccaggttaaagcaattctaccacctcagcctcctgaatagctgggattacaggtgcccaccaccatgcctggctaatttttttgtattcttagtagggacgaggtttcaccatctgggccaggctggtctcaaactcctgacctcaggtgatctgccggcctcggcctcccaaagtgctgggattacaggtgtgagccaccgggcccagcacaatcttatggcttttaagacattttcttttatgtgaagaaagctggttagataatttctattcttcttcctcaccaccgaaaggactcagactaaacaagtttgggcattgagggccaaactttgcttatagaaaatctttactcttgggttatcacatcactccatggagaatcaagacagtctaagcatagtccataagtaagacagagagcagggccttggggccatacaaatgcattcatatgcgctcacatttgtgtgtgtgagtgaatgggtttactcacacatttatgcaccaaatgtgctactatggagggatgaaggctgatcattagtgctgcaaattgtcttaatctaaagatgacaagttctagcaataaagaaaaaaaaaagctataaatctttctgtgtgcaagtcatcacgtccctgccttctgaatgtttttgtcaccatgatgcaggagccccttgttcttgccgtagagggataattgatgtgtatgaatattccagaatggaaatggaacagatgtagaaaataatggctcagaataatatttttgcacataagagctgagcctttggtaacgagagacagttaggggtaggggatggcgttgctcaagatgagctgaactgtaagcaacaattaccaacctttaaaggcaagaaaatgccctgccctccctccgccagcccttggagttgcctttgcaagagcttggatagggaggagtgtgggagctgatttttacttcccccagctcagcacctgctagggtttgcccctggtttaaataatgcagatctaaaacagattgagcttcattaactgtggtcctaaagaaagcaatatatattacatcatttcccatgtagacatgcatatatatttttttaaaacatgagaatacttctcatgaacttgaagattttcagtttcatttttttaaaagctagcaatgacccattaaactcctaaggcccactgttagattgagaaccatgatttgctagcagtatcaacattgtatctcccatctcccttgccacctcagtcaaacctaacaggagaatttactatgaatctaaagctagaatatccatatcttctctgttctctcccgcaaacaactcctcttgttctctcagcctccaactctctgtgtgtgtgtgtgtgtgtgtgtgtgtgtgtgtgtgtgtgtgtgtactcaggagcaagtaaacttggccttccaccccaccacacacacatccaacataagagaagctgaatttcatctctgggagggcttctaataatttattctattaagtatgatctgtgctgctattgttccactacctccatctctatgttcccattgggaagcagaattggccctaaggtttagggggactgacctggactgggaatcagcatcagaaacagtttttgcccagaaagagggtcttggtgctttcttttctttctctctgtctctgtctctctctgtctctctctctctctcctctcttttgccacacactgttatactgtggctgtctaggggagataggcatggtagttactaggagtgggtctccctccttcacctcttctcctttaacataatgctttttgcctttgtgtttccaacaggtcagcggacagattgcagtctagccaggtgagtgtggcctgggacaggcctgggaagtgatagaggcttggtgggtagagcaatcttactctgggagagagccaaggagttgagttgtaaaggcattgaatgactttacaaagcaatggcctggggcggggtttgtttacttccctttgccttactgaccccatctgatctcagatagaaatggggttttctgggactttgagaaggagctaagcagaactgagtaaaaggggttatcatttgctgaaattgtcccagagaccccctaacgccactgaattgcaagtaacataaacattcaactgtagaggattctggtaacctaaccttagctgctagacttcaacataggggctctggggagtctctgacccagagaaagaagatcaggagatggcatttgattttttttttttttaatgcccagaaaagaaggcagcccctaattagtagtgactgttgctggataatgaaatattacattgcattggctcgccaaagagtattggtagaaatatttgcctgatgtacaagtatgcacccctcccaatctttccccaccttccccttcctcctccaccccagccaaatattttccctctcagtcatggtgctgctatgagaaaatttgtgagctgtcggagagcaaggtattcattcatccagcagttctcagatgcctagaaatgtgctgatttaactagagaaggggctttaatgggttggactccttagagaccctgggttagcccattatatcaaccacttatatctgccaaaacacataataattatgaggccatttacaattataggttcattatttagagatagcttcatttggctttcattgttttgtcattgtgaattacaataaagatcccattaatataccagtcttgatgactggagggaaccaggataatgggattctctggaacacatctttttggtgttagagtcttactgtaagttcacctgagctcctgagtctgtggaaggctctgtaggactgaaaagagctgagttgaatttcccggtgctgagttattttgctgtgagaccttaggccgctcttttcccctctctgaactctggtttcctcttatagaagaccagagcactccactagattcaaggtgtcctaggattccaaaggggttcctcaggagtggcctggtggcaggggcagagcgatgaccagcaaccaggctctggtcccatccttcactcagagcaggacagccctggcctccttggtttgggtgttatgcctctgagtcagattccctttgagaagaggcttctgaggctaaacacagattggaaaacattgacctagaggattctcaaggttgtttccaaactagatgttctacactctaaacccagaaaaattgttccctgtaaagatagcgatctttaaggatttcctagagaaacaaaacaaaaagcatcctttggtgtttcccagtgtctcctagcaggcaaaaaaatcttcttattgtctagcccaaaaatattttactaaaaattgaaccagtcctctcctattctaattttgagtagtggtagacattaaaagcagggacgtctgtgcttttgtgaaaaaaaagagctttcgtaggctttattgtggaagtaatttatcaagtttcttagccatttctgggactgaactgagtaatgtcacatgtttcattggctaccacacagattttttttaattattaaaaactttacttctgggtttaagagtgattgtttatctcattcgtcccaattttctctttttctcccttgttgctggattggtccaatctgattcggcgggattggtcacaggcgcagctcaactgtgaggaaacaggtaagggcccaagcggggccaggctggtctggcctgaaaatatagtccatcccacaggcatttattgagcgccactgtgtgcaggacagacacctctgacttcatgcctgcatttggaatgtatcatttagtcatagtatgtttaatatggtggcaatgtcattgatttaactagttggagtggccatagtctttttgacttgtccctctcctttctagtcatttatcctcttgcatactaggggtttggtttcattggtgcagattgttccagaactgcccatggcatccttttccaagaccacaaaagaggcttgacacttcctacatttgtgctaacatatcagtaactcacagcacctaattagctagaccagacaatctcgctttaagttggcagattttgtttgattgtttccggtggcgtagtcattctagatggattcctaagacatgctaacaatgagaagattaagtctggtctaggaacgataggcaagggccgttcaactctgcaatttggtgcatgatcttcagtgttgtgttaaaatctgccactgggcagccagctctcattacccatattaggagggctcttagagagcagtggcatggataatccacatcaatggataatctaaacagcacttgtgcttgtttaaaaaaaattaattgaagtattttttgcagtagcaaaattgacttcctaattatactttatggcaaatactgaaatgattttatgtcccctaagctcataccagctatgcagtagacagcagggagggcgggtggagagagctcagaaatgtctttgtgtctgctcaggggaaagctaatccaggctttaaaaaatcattttgggtaattctcagtggctctagccacagggagataatcgaataaagagggcgcatggtttttatggtgtcggcagcaccggcatttcttcagctcatctgactgctctgacagggtggaccattaagctggggaacttggatgatacaggcctcgcttgtctcagctttgctgtcactattttccccttctctactttgaatctcgtcttaatgagtatgccatcagatgcaattacacattttttaaattataaaaatttaattgcaagtctcctccctctttttcctctatttctttcttcctcctctttcttccataatttcatttaaaactagagaggaatggagtgactcctagagataatttagtgcatttaaaattaataggtgcatatcttgcagagggagcaagccattttccctttaacactaagaaaagaaatgagcttgaagtttgttcttttcagttccttggctgaaaccaggcatcttgcttatagctggagcatgtttgcaaggggtttgcagctccactgtggctgcaggagtgccagagacatcagtttggcaggtgatatgtgcccttggttgggctcactgttggaggggaacagcacccatctggtttgcatcctgctgcacataagcagttgcaggcaaagtgtgtttgcctggtgctagatttgcgtaggagttacaagatataccaaaatccccaatccaataaagaccttgttttcattctgctgccccagtttctctctagcagttcatatctactagtggatcagcaagaagttttcctaagatggtcaggaagataaaatagatagtaagttacttggaaggtgagtaatcttatataagtaacaaggaaataattgtttgtttatggcaaatcaggcaaacaagaggaagaagctagtagtttttgtttttgagggtctttaatgggttccggtcatttttgaccctgtcaaagactaggtttaaaccatcccagaccttttttaaaaaggagacagtctcactgctgcttccagaccttccctgctccctgtaacctcagcattatttctctcctggccatgacttcatatcttctttgttggcctttctccattcctctaaattgaagcatttctccagggctctgtcctctcacgatgtctctctatattctttcctttgtcactcttgttcccttagatgaatctttctcttcttccctaagcattcttttgttctataatgctgtccttttgagtccaatgagtaattcctcagtgatcgactagacattcatacttgaaagttgtgatagcaccttctaccttcagcatcagtctcaccgtcccccatcacattttgatttgcgtagcccctcccttcacttctctgtttgtgttcggggggactccattcttcacagtctctgaggccccaaatcttacctttgatgcttttttcatcattactcacatataatctgttgtcaagatttgtattttctcccttggtaaaaatgaaaattaacaaatgtagtacaaataagtacctaacaaaaactctaaccctcttactcatgtgaaattatgccagataatgcatattcacagattttctggccacctttctgattttttttttttcttttttgagacagggtctggctgtgccaggctggagtgcagtggcacaatcttggctccctgtaacctccacctcctaggctcaagcagtgcacccaccatagcctcctgagtagctgggactacaggtgcacaccaccacgcctggctaatttatgtatttttttttttttttttttttttatagagactgagtttcaccatgttgcgcaggctggtctcgaattcctgagctcaagtgatccacctgcctcggcctcccaaagtgctgggattataggcgtgagccaccacgcccggccctttctgattgttttctcctgcaaattactggaccactgctttactatgttttccaacttaggccctacctttctccctctacttttggtttaaagttcccttaatctgattggatgagaatttggcctgattccttaaaggccccttctaaccctaagatttcattaccaaaaaataaaaaagtgtatgaaggaattaagctgacaaggatttctaacattggaggagggaagaagacagagagaaaggaagagacgaatagtacataaaaatgtagacactgctcagtcagtgctcacgcctttagtcccagcactttgggaggcccagatgggcggatcacctgaggtcaggagttcgagaccagcctggccaacatggtaaaaccccgtctctaccaaaaacagaaaaattagccagccatggtagtgggcacctgtaatcccagctactcatgagtctgaggcaggagaatcacttgaacctgggaagcggaggttccagtgagccgagatcatgccattgtactccagcctgggtgacaagagagagactctgtcccaaaataaattaagataaaataaaataaactcagttaactctatgcaagggcagtggtgaagtgcaggtcttcgtggcaccacaggagtgcacagacacatcccagggaaattaatttactcattgctcagaaacattataaggagagaggaggatggcaggagcgttcaaagcctttgtgactttgtccattttgtgctcctactggactcttagactccactggagcagtggggactagaaaaatgcctgtgcagtaggacaggtcatctttagcccacccttacctgccacaggttatccattgggggctgcatgtgagtgctgctggtaaccacggacatgcaggttaatatttttcttgccctgtttcctgccaaccctttgtacttgcctttaactaccactgatattccatttcctgcaggccaaattttgtactcacacaatttgttgaagccagtagcctgtaagctttccagctttcctctctctaggtcataatatataaacctaggaccaacaaaactatgcaaacgctcatatcactaacttcattatcactgctgctactattttttaataatttatattaatacacaataattgtacacacttatggggtacatgtaatattttgatacatgcatacaatttgtaataaccaaatcaggttaattagggtatctgtcatctcacatatgtatcattttttggtgtgtatgtattgggaacattccaaatcttctatctgttttgaaatatccaataaattattattaactattattatcctactgtgctatcaaacattagaacttatttcttctatctaactgtatttttatacccattaactaacctcactttttttttgttttgttttgttttgttttttgagacagggtctcgttctgttgcgcaggctggactgcagtggtgtgatctcagctcactgcaacctctgcctcctcaattcaagcagttctcatgcctcgacctcccaagtagctgggattacaggcgcgcaccacaacgcctggcttatttttgtatttttagtagagacagagtttcgccatgttggccaggctggtctcgaactcctgacctcaggtgatctgcctgcctcagcctcccaaagtgctgggattacaggcgtgagccactgcaccctgcccaacctcacttctttttttttttttttttgagatggagtttcactcttgtcgcccaggctggggtgcaatggtgcaatcttgcctcactgcaacctccacctcctggattgaagcaattctcctgcctcagcctcccgagtagctgggattacaggcatctgctgccatgcccagctaatttttgtatttttagtagagacaaagttttaccatgttggccaggctagtcttgaactcctgacctcaggtgagccacctcacctggcccaacctcacttcttgacccctcactccccgctacccttcccagtctccagaaaccgtcattctactctctgccttcatgcaatcaaattttttagcttatagatacaagtgagaatatgcagtatttatctttctgtgcctggctaattttacttaacacagtgtcctccagttccatctatattgctgcaagtgacagaattttattcttttttatggctgaataatatttcattgtgtatatataccacattttacccattcatctattgatggacacttaggttgcttccatatctcagctattgtgaataatgcagcaataaacctgagagtgcagttacactgatacttcaatatactgatttcttttcttttggatctatagccagcagtgggcctgctggatcatatggtagatctacttttagtttcttgaggagcttccatactgtttttttgcggtagctgttctaatttatattcctgccagcagtgtacaagcattcccctttctctgcatccttgccagcatttgttattttttggctttttgataattgccattttaattgtggtgagattatttaaaaatttgcatttcttatgattagtgacattgagcattttttcacatacctgttggccatttgtatgtcttcttttgagaatgcctattcaaatcatttgcccattttttaatcagatagtttggttttttgctattgagttgtttgagttccttatatattctagttattaatcccttatcaggtggatagtttgcagatatcttctcccattctttaggttgtctcttcactctgttgatcgtttcctttgctctgcaaaagctttgtagcttgagataatcccatttgtctgtttttgcttttgttgcctatgcttttgaggtcttactcaaaaaatctttgcccagaccagtacccttgaagcattgccccaatggttttttttttagtcatttcatagttcaggtcttacattgaagtctttaatccattttgatttgtttttctatatggtgagagataggatctagtttcattcttctgctgctattatttgtaaatgagaaatgtaataacagaagtctgtaaacataaaaagactccccccagattgagcttttctggcattttcatagtggaacccagtttcttccttagaatagggaagagaagacaaagattcttcccctgagatcaccctagcctaaccagccagtcagtgatgccgacaagaggacagacactggctgctgtagctggaaagctggaggaagcagatgggtttgggggtcatgaagatgagcatttgggtcgctgcgaccgtcctgacaccagctccaacttggcacatacagtactccctttggcatcatccctggttcccagaaagcttgagaggtagaggctaagccagcttttctctcagcctgacttttttgtgagacccagctgcttgcctaatagtggccaaaccctatggctacagtggcaaattcagagccaggggagggatccacgcagacctgtcaaacgggcagaagctacacagacccatcgcacttgacagtctggtctctgtcctgaacatctaaagccctttctagttaagttcggtcccctctccctgatctctttcttccacacagctgaattattgtacattcagctgcattataaaaccctactggtttaggccaggcacgatggttcatacctgtaatcccagtgctttgggaggctaaggcaggaggattacttgaggctaggagtttgagaccagcctgggcaacatagcaagaccctctatgtaaaataaaaacgtgctgggtgtggtctgggtacctgtagttccagctactcaggaggctgaggcaggaggatcacttgagactatttgctcaaggttacattgagctatgatcgcaccactgcactccagcctaggctacagagggaaaccctgtctctaaaaacaataaattaatttaaaatataaaataggccgggcgtggtgactcacgcctgtaatcgcagcactttgggaggccgagacaggcggatcacgaggtcaggagatcgagaccgtcctggctaacacaatgaaaccctgtctctactaaaaatacaaaaaaattagctgggcatagtggcaggtgcctgtattcccagctactcgggaagctgaggcaggagaaaggcatgaacctgggaggcagagcttgcagtgacctgagatcgcaccactgcactctgtctggcctgggcgactgattgagactctgtctcaaaaaaaaaaaaaaaaaagaaaaagaaattgtatatataaaataaaaccctactagttttgagtaatacttggtatgcacacctggcaatgtttgctgaatgcctagggtgcagtatgggtagtggcaaagtgttaggtctccgagggagattgcctgggtttgaatcctggttttgccacttgccagctgtgtgaccatagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgccaggctatttttagtagagacagagtctgttgcccaggctggtctcacactcttgatctcaagtgatctgctggcctcggcctctcaaagtgctgggattacaggtgtgagcgaccgcacctggcctcactttttcattttaatgagtataataataataatatgtactccataggattgttaccagcactagtccatctaaaggacttagtacatggcctcacacctctttaaattcctctataaatggtaggcactaatgttcatgtgttaataggaaatattactctccttgcctccagtcccctccccagtctgtagaaggcaaattgaggcccaaaaaagttcagtgacatgagccagactgtgaagcaaaacaacagagcaaagattgacatctgggaggcctgcttctttgcttagtacctgttagtccccactatttagagttagtttttcttttctatcttacctttataccaaacaaaccctctttctgaagctcccattggttcattctgctaccttcaactgagaataattgagcacctcttatgtgagagcatcatggccaaccctggacacccaggaattgacataggatctgctcttgtgaagtttgagctgtagtggtgacaagtgccaacaaatattcacatccacacattggagtcacagtcagggttgaggagaacatacccccagcaggagcagctcatgcaaagccacgaggcaaaggaggactttgcagaacagaaacgtggccagcatagctgtagcagaagctaggggaaagaacaggcagtggaactggaggcacaggcagtattcctggcatgcaaggccgtgtaagagagtaatgagaggtctttgaaagagtttaaataatgaaatgtgcccttttaagattacctaattactatgtgaaggaagagaaatgcgggtcagaagatggcaaggatgggaattgaggtattggtggattgaactaggttgggggcagttgagatagagagaagcgaatggatttgagagatatttagaaggcagacatgacagaatattaattaattaggtggtggagaaggtggtgagaaactggtttggggcagaagatgatcagttttgtttaggacatgctaactttaaggcatctgtgtagcattccatgtgggtggttgtatttttgtgctctggaacttggaggacaggccaggtgcttctttgtagaccggctggtgatccgctaagacagttctgcacggtttggcccgttttctctgaccctgggctatccctgtttgaatattctaatgttgtgtttccctttggcttttcaggactccagccaggcaattcctctggtggtggaaagctgtatccggtttatcagcagacacggtaagcaggatgacagccttgtccatatttgtgcaaagattgggaagaacttccaggaattctttgtagagtaagaatagagattgacttcccatcctggcattctcagaaaaggaataaattcttacttgtccacataacttttgctacctcaaaatagccacacctagacattgaaagaaatgcatcatatattttgacacaaaatgcctcagccacttatcacgcagcatttttttagcttgagagtaagtttgaaattgcagctgttatgtaaatacagctgctattatgtggtaacagtagtttcaccattactcacagtctttgcaagtgtgggtatctcccactgtacagcctgaccattttgtcactttctgtaccagactagtttgaaaacaactcctttcccaatgttgcagtgattcctaataatcagtttttgttctggtttggtctcactggatacagcatggccaagggctgagttagtagctggtcttaaagttgtatccaacttttgagaatctgcagaggcaggctgcttctcagcctaggtgaaatcatactctcttctacttggatgaagctgaatcttataaacaccattcctcaccagctactggtctcattggacagaatttagcgatcgaaataattgccagagaattgatttcccagggattagagtgtttataaaggacagaactagtgctatgaaaatttctaggaactgagcatcagaaattgtttttagatgctgttctttctgtgataggaaaaggggcagagtgacctttctggagctaaggaggtagataaaatattgcttgtctaaattcagaggcagctattctctctccctctccttgtctttttctctccctgtaaactgggacattgctcaggttcatttttggaatagtaattattatagcatggttacaattgatctcattctaatcagctataatttttaaattttatccctattcatttaaagtaacagcattgtatatcagtattgaacagtcaacaaatttatcaagtccctgatcaatgctgggtaccatgcattgccatgcaggaaaacagaaacaggaataatatactcttcctgtctttaagtggttttgtgatgcagttgggagaaataagtaagcaagtgataagttaaataaaaagggataagctgtggtaattcagaatagagtataagaaatttcacaagatagtaatgattaacagtcaaacagtttgcaaagaaaagtccaaacggagttcaggggaggatgaattatttgtgcctaagagacaataggaagaagaaagtctgagccactgttcattagcatacatttcattcattgaacgaatacatattagttgcttattatatcccaacaaaaagtttctgccttcataaaccttacattccactgaaaggtggataagcaaatgaccaattgatcagccagtaaatacagtatgtcaggtattggtgaatgtcatgaagaaaagtaaagcagggtgaggggatggagaaggaagagggaacactgtttgaagctggttcagggaaaaggcctctcctaaagtgacattagggcagagttgtgagggagtaagccttgtggatatctggggaagagtatcttggggagcgggaacaagtgcagagatccttgccatatgcaggaagccagcgtagctggagcagagcaaatgaaaaaggaagcggcaggagatgaagctggaagccagactcttagggcctcatgtgctaggattggattttattctgaggaagatgggaagccactggagaattttgaacagggagtcatctttttaaaggatccctgatgctctatggagctaagactgtaagaaggagacaggaagcaactgcagtagcctgaggaagacatgatggcggcctagaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatccagcagatcctaggaattctagaaatttgccatgaagttacatctccaacaatacaaaaatgcatgcgcacaaggttatttgtgacagcattgtttgtagttgcaaagtattagaaacaacctaaatgcccatacatagaggagtggttgaagaaactatgggacattcattcaatggagtactatataagaatgagtaagatttccttgaactaatatggagagattcccaggatatgttgttaagtgaaaaaaacaaaatgtgaaagagtctatatcatgtagaatactacagatgctcctcggcctctaatggggttacgtacggataaatccatagtaagttgaaaatgtactcaatatacctagcctagggaacatcagagcttagcctagcctgccttaaatgtgctcagaacatgtacattggcctacagttgtgcaaaatcatctggcaacactatacactgtagagtatgtgttgtttaccctggtaatcacgtggctgactgggagctgtggctctttgttgccgccaagcattataagagaatatcgtactatattttgctagcacaagaaaagatcaacattggaagtatttctcctgaatgcatatcattttggtaccatcataaagtcaaaaaatcataagtcaaactattgcaagtcagggactatatatatagatattcttttgcatttcattaccttttatataagagagaagaagatataagaatatccacgtatcttctcatttctgcaaaaagaaatgcaggaaggatgaatctaggaactaatatttaattggttacttataggggatggatggaaaaaacgtgaaaagaatggggcaatgggaaatggtaaggagtggcatttctcttaccttagtgtagttttgacttttagaacaacattagtgtttcctgtactcaaaagataaataaacaagccaagcatggtggctcatgcctgtaatccaagcactttgggaggctgaggtgggcagatcacttgaggccaggagttcaagaccagcctggccaacatggcgaaaccctgtctctactaaaaatacaaaaaaattagctgggtgtggtgttgggcacctgtaatcccatctactcgggaggctgaggcacaagaatcactcaaacccaggagatggaggttgtgatgagaccacaccactgcactccagcctgagtgatagggtgagaccctgtctcaaaaaaaaaaaaaagataaataaataaataaaggcagagtatgggtacaacccaaaatggaatgcagacagtaacatataaacctaactgtattacaagtgaataacgtaaccacaatgaagagaatgaggaagaaaataacctaagtaatttgtcttgactgtaatataaatctgaagataaaaagatctctaaacaaatattttacagtaattagtaattttttatcacacaaatatggattagcaattctaaaagtattttatatatattctaggatcaagcaaatatattgtggattttttaacaattgagcacatagtagctgctcaaaaaacatctgttccactaaattgatttttcccaaataggggcttaaggtgctcatgaactccctaaaaaaccatagtaaaaatttttgtgtataggcatctaatgaggatagagctcataacctgtgtcagtcttgaaagagtctgtggcccactgaatgctggggattttcacatcctaactatcctcaaatcccatgggaggtagacattatagtccccattatatagatgagaaagctcagtggtgggtgagggtgattcaggaaggcttaaaggaagagaagcgatttgaggaacaattgaaactgaatcatgatggaaaaaaacaaaaaaacaaaccgccattttcatgaggaagggagcaagataacgtgaacatgagatggctgctgtagaaatcatttgaagaattctccaggagaacaacttttggcaatggttggatcccgtgcacaatggaaggttttgtgccatttccaaatagcttagtccaagtctgatgagttttatactttcatgttcatgtgaactgagaaaaaatttaaaagatcatggatgtgtcactttggttatgtaaggattcgcctgcattataataaaaagccaactggtttttccctttactttctggaaaccagccacttattaatgtttctgcttctagaatctagagattctgtctgttgagcaagaacacatagtagtccctccaaaacataagttctcaggaggaaacagagaccagacctaaagagagctccatgtgttccaggcctgctgcctgatttccaatgagctctcctctcatttcttcttgtcctggacccccaggccaaggctgcttttccttggtgtcctaacctaccaaaaagtatcaagatgatgacgctctttcaagaatttgtgcaatggcttcaccaactagaacatagtgagtagcctggtttccgagatgacatttgcttataccatgttgtgacatgtggctgtttctctcaaagcacttgttgtttacatactatctttaaacaacattatctggcttttacatcccatttgtaactagtattatagtcctattacactggtactaatgaggttttaacattgcctgccactctgtgaggaatattctggagattcctttataggagcagacaacttaaggcctattacaagccaggtaactatatttcctctgcttactttttaatgttgtttcagttggattcaaaatatcagtcccggcctatgtggtttacctccaaaggtctaactgatagaattcatctgcctcctcactgagaaaccctcaaacagtgggcaaaatgtagcattagtccattttgttttcctaaaataaaatttgagatttctccagcatgtcaaggtttttgaaggattgtgccgtaacagagggattttgacagaatgcttaagattgagacccagggatcctgagaaaagctgagcggtcctgatgcaatcagagatgctagtccagtccaacccctggggctggcactgatgacacacttgctggatttctcacccgttttgcagttgtgtgtgtggtgctgtctgtaaagccatgtccatgctcagactgaccaatgtggttccagcctctgcacttgcactccagtagactccagaagcctggtgttgaggactgagtatgattgcagccacaaggcctgagtttgagtcatggccctggttcttacttcctgtataacttaaggctgactatcactcatcaatcccctcatccagagaatgagattgttgccaacctttaccttgttgtgacattattatttctgaggaccaagtaatttatttctgtgaaagcattgattagcagcagtcactatgccagcatttttttcatgatttttttctctaacaaaaccaagaaattcttgtgcacattatcgtagtataacattcatgcatgtttgtctttagagtaaagctgtagtcaggaaccagtgcctagcacaatgtctggcaatactatctgttgactgatcacttcatagcaagcttgttcaacctgtggcccatgggctgcagcacaaattcgtaaactttcttacaatattacgagattttggggggattttttttttatcatcagctatcattagaatattttatgtgtggcccaagacaatttttcttccaatgtggtccagggaagccaaaagattggatgctcctgacttatagtttcatgttctctctttttcatgagtattgaaagcattgcccccttgaacaatcaaaccgtgttaaaacagctaaagcaatattataatctcagaccttatgaaactcctctgatgagaactaatgccttgacctatttcccattcttttttttttttttctttgagatagagtccactctgtcacccaggctggagggcagtggtgtgatcatagctcattgtagcttctaacttccaggttcaagtgaacctcctacctgagcctcctgagtagctgggactacaggcatgctataagcactgtgcctggctactttaaaacattttttagagacagggtctcatgttgcccaggctggtcacaaactcctggcctcaagcagtcctgctgcctcagcttcctgagtacatttttctattcttgaccctagatgatttaaaaaagtaccaatgggtcacttctttgctttacagatgggaaaagagaggcaaaacaagggaaggaatctgcctcatagtcgcccttggagtcaaaggagtctctaacttggtgctttctagtgaaaatgaatgcctcgaaattattccagtgacttttccaacatccttgcacatgtttttctcctttggcctaaagaagagagacagcgtgcttaaatacatgctggctgggggagacagatattcaactaagcttggcactatgcttgtgaatttgctttttcttcttcttgatcacttttctgtgtatttccaggactacagcatgaaggaattttccgggtgtcaggatcccaggtggaagtgaatgacatcaaaaatgcctttgagagaggtaaggaaacagtcttgaagataaaaccaaatatttgccagccccctggggtattggctccaccctttcttctctaagaggtccccagaggtcaggaagccaacttccctgtctcttcagggggtacctgctgtcttgtacacattcccctgtagatatgcagagaaataccagggcacatcccagtttccttcttctttcgtagccctacccatcctgcctctttcacgccgatgatctgccaaaacccaagaagttaactatgatatctgggcggtttatggcttcatccggaacccttggtagcagttaatatcaaggctaatgcgcttgttcattgtagcccatttattattttgtgggctattaaggtaatgggcaagctttggcaatttccgtcactgtaatggatatatatagtgtcaatttgaggttggccctatcattaaatctaattacatctgatatgaaattttccatagggagctctggcatgattgttctgtaagtaggtgttcttggttgcaggccaggagacgtgagagccagtctcaggagctggcctccttggcctcatttttctccccgcaggggctcagtcccagcctggtttcatgattcttgtgagatacagttgctgtgtcccatcctcagcccatagggaatgtccctgagccaggctggcacaagagagtttatattggtggactcatctgccgtgctttggtcctggagcccctgaaatggagcagtctttgctttatctgttccctggtctgtcccactcatggccaccatgccgggcagaaagctgatggattgggaccaggacatgcatggttcaccccttccccacgttcgtcctgtgtgtttttgcctctctcactctctttccttttcgtgggggttgcttatcctcaggagaggaccccctggctggggaccagaacgaccatgacatggattccatagctggtgtcctgaagctttacttccgggggctggaacaccctctcttccccaaggacatctttcatgacctgatggcctgcgtcagtaagtaccattctggcttcagattggcttctgggctacagcaccggtagcaagagagaaaaagtttccacagggtctgtgtgttctcataagcttttcaatgaagtttttcttttccccagtgaaatttctcctcagcctcactccttcatcccctggtgggaggggaggaggaaagacttttcagtaagaatctaggaccccccaagtcagtactcctggcctttttttttttcttctgattcatctctgggctttatctttttttagtaaaatacctttattttcaattatgtatttgaagcttatacattagtgcttgtgcttttcatggtacaagggggaaaagcataagcgttgcaaatatttcatgcttgttgcattaaacaagacatggcttacctgctaaatgtattaatatgtgttctaggaacaaaagccctctgcacatttaaaagtagtaataggatattttcccaaagagaaaggtatattctctgctttatcctcttaggagttctctgcctcttactctaaaatttgggtcttgaaaagctattcctagccatttggtttagcttgtggtactggaacaccctctcatttgtttgccagggaaaacaatcaatggaaacttggattaatacaggtcagcctggaagcaggccctgtctgactgatggctccagaggctggagggagtggtacctttgaatggagaaaagatccttcttcctaggttgaccagatcttcatacctgctgagtttccagtttcactcagtatctgccctgagtacttgtccctctctgttatcctgagaaatgcccagggcatttgggaagctggctctctggtttgttttgttgacttctgtttgtgggagtctagtggaagtgagttatgtgggtgattaagaatgtgattcccttgggtcatgtctttgtctttttccgggactgggcctaggtgaagtatcttaagctgaactggggttgccaagacagttcaatatcccttggctgcccagttcttccctagagatacactcttcttcctaatccagtacttcccatctctttttcatataaaggcactcatagaaaatggcagtgtttacatggcacactgtggaagtgagaggctgcctatgatggaggacctgtaattgacctataattaacctctccacagcacaagaaaacctttcaggtctccttcccaatatcactacatacccaggggcctgctacctcttgcctcaggccactttttactcattcatagtgcagataagggagggagaagataagccacacttgtccagaggatgagatggcatgtgtggagtgagcaggacaggcctcttgcacagcctctcttcccaccgagaagtaggccctttgaggctttgtgttgagcagttacagcaggttggcggcagctccctgtcagtggttgtttgaataagagggtggtagatcctgtggggaacatttctaaccccatttcctgtgcccaaatccaaatccaaacttgttattaataacaatgagattacaacaaccctagttcagtttaatattaataatgtgtaataacgagtttggatttggatttggcacagttccctgtgcccaagaagtatacaccttacatccggcaatggtaaatgtctggagcccagcaggtgccctcttctaacagccctactccaaggagcaacagggatgacactcctgtcactgcaccagtgctgtgcgtgggcttgatctgatgctgtccgtgttgcccctgctggtagtagggacttctgatcattactgcctgggatcccagtcatagtggaggataacacatggctttcttcttttcagcaatggacaacctgcaggagagagctctgcacatccggaaagtcctcctagtcctgcccaaaaccactctgattatcatgagatacctctttgccttcctcaatcagtgagtagccttcccagtgaacagctggatcaggctttggcttgggcactggaagttcctctatggacctatgcctattcatccatcccaacaaaatatttattgagcacctactgtgtgctagccacagtgctagacttatttaatacatcgttaaataaaagatgaaagccttgatataatttagctcctgttccagggaaggaaacagccaataacagatatatcaggtagaataagtgcttagaagaaaaataaaaaagagtaaagagaggggaaagagtaaaggggtctgaatgaaaggagggagaagcactgtagttgaggtggacagcagaggcctgcctgagaagacagtgtacaagcagcagcccagaggaggagaaaagagtgccacggggccatttaaaaccccagagtcatggtaatagcgagtttggatttggatttgggaagcaattagaagattttctttttttttttttgagacggagtcttgctctgtctccaggctggagtacagtggagcgatcttggcttactgcaacctctgcctcctaggttcaagcgattctcctgcctcagcctcctgagtagctgggacccaggcgcatgccaccacgcccagctaatttttgtatttttagtagacatggggtttcaccacgttggccaagatggtcaccatctcttgacctcgtgatgtgcccacctcagcctcccaaagtgctgggattacaggcgtgagccaccgcacccggcatgttactatctgatttgtgtattttatttttttaaaaactgccaactgctttgtggagaagttactggaaagggtcatgaagagaaacagggagaccctatcccaaggttaccatctggtctggccagaggtgttagtggctgagtctggagagcggtgaggaggggtcaggtttgtgatacattttgaacatagcattaacaggatttgcccatggattatacatagaatatggagagagaaatcttaaattgttggcatgagcgacagggacatagggtggtcatttatggagttggagaagacaaggtgtggagaaaggaatcaagacaatgtgttgatgtggtcatggtcatttgaggcacttgtgagatgtccaagtggagattttgaacaattggacctaggaatccaacccttaagggagaaaccaggagtggagctgccagtgcaggagttgcccatgtactggtggtatttagctaatcacccagggaacggatgtgtctacaacaaaggtctgaggagcagagggggccgcgggtgtggatggggcatttcttctcgtccaagcagcatgtccttgtgtggagcaagctttggagtccccacatgacaggaaaggcaccaagcaaggacatgtgattcttcccctctgaggcacctctgtcttttcactttggttttgctgcagtttcgccctcaacagcctagaccaaaggttataaatgggcaccctgagagccagataaagccgaagatgtgttctcttcaggtgtctattgtgtcttgagaacaatgaaatcatacttacatttggggaaatttcactttttaaaaacctagatttctagcttcttttgaaaaattattagatctggtgatactgactctgcagtccctggtggcagcaattccctgtggagtaagggctgtactccctagatggggcaggcactccccaattcaccacagtccccagccctccccgttgtcccccaatcctgaggctgaattcagttgctatttatcatcactcttgttttgtggttttcatagagaacaaaaatgtttctctggatccatgaatctatcagagtaggggaaacaaaaggtaaaccaagggacccaggtgtttttgcacatatttctttgtgaaaatgaggagccttctacaaggttagtctctgcttaaaaggaatacaactttagagaccatttcataagtgtcagcttgcttccaagtttgtggtcaacctggccttataggtatctgggttagtggccccagcttgagaccttttctggggcacccacactatcatgtagcccccttgctggcccttcagagctacagagggtccttgttccccatcttgtctcttccatgcggttgtgtctgctctattcattggccaggccctgactcagcaccaccactgcctttgggttgaacaccccagtgagtcacacagcgtgttcatgtgcagcctggaaactctgctaattactctcgagttagtcccttcagggctaccagtcattgtctcccctcagagaccaatacctgccctcaacatgagcctcgtctgtgcccccagagctgggagcatgacagtggtgagcaaatggggatgaggggaaaacagggagggctgggggactatatgtgacagtacagtggggagaaacaatagaataagcatccatgcagggttgctgcttgcagagatggcagccactattgaagacagcataggaattgcaccaattcaaattattcattttgttttgcttttattgggtttttttctgattgaaacgagattgatttgctcatcaaagtgttaacattaaaaaaatgcagcattaataaagtgttttctaaaataataaatagaatgcaggacacaaatgataaagcagaccacctccacaggaagacagcagctgacaggtgtgcacttccggacaggggtagcaatagttggcaggtagctcccgatgcagactctgcctgggcccagaccatcaggaccctttttcttcattgctgtgagtcctggatgtatgtgtactttatttctggctactgtttgttcttggattggacacattgtcaatctcaaggaaccaaaaaagctaatatctcagtttctgtgggtctggaatccaagtacagcttagcaggggccctctggagaggtaattgcatatcattaaaaagttaaaaatccagaaaagtgcatgctaaaaagtaagtttcccaacaccaatcctggcgccccaaaaagcctctgttcctaaccacaatgctgaacctttttatgaagcacaaaagatgagttcaaatcagttaggagaattcactaataatatgaactgaaactgtagaaatacagtagaactctttgaggacatggcatgagtgactacaagtcgacaccaaaaattttaaagcagagagttgttactaatgttatccattttaggtatttctttgtttttattttgttgttgtttgtttgtttttgtttgtttgtttttgagatggagttttgctcttgtcccccaagctggagtgcaatggcacaatctctgcttacggcaacctctgcctcccaggttcaagcgattctcctgcctcagtctcccgagtagctgggattacaggtgcatacctccacgccagactaatttttttgtatttgtagtagagacagggtttcaccatgttggccaagctggtctcaaactcctgacctcaggtgatccacccacctcgacctcacaaagtgctgggattacaggcatgagcctgtaattacaccgcgcctggcctagatatttctttaaaaataaaaatccagttttttatactcttacactagacacagccttcagggacttcaaagattattaacaccatgacattttacacaaaactgtgtgcatttatatgcgcacatatgtgaatttttctggggagagaatccctagtttttgtcaagttattgaaggaacttgtgtcccctaaatagttaagaaccactgctttaggacaggcgcagtagctcacacctgtaatcccagcacgttgggtggccaaggcgggtggatcacctgaggtcaggagtttgagaccagcctggccaacatggcgaaaccctctctctactaaaaatataaaaattagccaggcgtggtggtgcacgcctgtggtcccagctacttgggaggctgaggcaggagaatcacttgaacccaggaggcagaggcctcagtgagccaagattgtaccactgtaacccagacaggcgactccgtctcaaaaaaaaaaaaaagaaccactgcttcagcccctaaacttagatgttcccactgtatattggaaaagaaaaatggattttcatctgtattttgatgggagcaagaaaatagacctagaatcatgagaccacagtccacaaagatgtgtcctcttcaagctcctggtcattgtagccacctatgaattgaacagttcttaccttagcaggcttcccaacattcttcatcttccacagagctttgactcaggactctcaggactagagtttgtttccctttgaccatcaggcttcccagacactactggttttcttttatgttaccaaaacattgtcagatcactctaaagtatcaaggccttcctcctctttgtccctccatgacaccaggaactggccagccttggattagctacagcttaagcctgcagcacctcatgcctcagttgtttgctctgaggttaccaaggtaattatcctcctgtccctccccagttttaatttgactaggaagtagacttagaaacttcccctagtcttttctaaatctctgctctctttgaactcaggatccggggaaggattatacacttttaagaactcctgtgaagcaatccaatgagatttgtaacctcccccgttgctggcctctcctgcatttgattccaggctctagagaacagtgattctcaactcttttctcccatcacgtccataataccactcttcaagtcctgcagtgattcgcaaacagacagggggtacatctccaggaggggagagaaccactgagtcagagggtaatgggctttgtaatgtgaggctggatgaggggtacactacagaaacaaactctgcaatcagttctgaagaacagctactcagatggagacagctgagtctcaggcctcgtttcccaacagaggacctttggttccttctcagaatcaaatcctgcccatgcctataagggagactcctcagcagagctcacagctctgcaggctgtgttggggaggtatccagagctggcccagccctcaatgcctggacgggcaaggcccaatgggactcatcaggtgcagtggctcattgaaggccttgggtccttggccaaggttggaggtgtggctggaacagctgctggctgagaaggggagagttcccagaataaataaatacccgagaatgaagtcagcctgcatccagaggaagcccgagcagaagccaaatggcatgctgaccttttcctgaaaaaatcctgaatgtaataatatagaaggagattatgaacacgaaaaacaattgcatttgctgttctaggaagaaattcactggcttgatggaatacaaaagctaatcagttggctatttgttaataagtctagaggctagaaaggaatatccctaataatttgattattttgttatgcaagaaggtacacaatgcacagtgcctgtgcctctgaccatatctttaccagggcagcctgagggtccccgtctgccctggcagcttagtatgttggtgtgtagcagccatattcagctctgcagagtgacatgttctcaaggtcatgtggcctttgatagataagatccggggatagggatgaggatggggtggtaagtagaatttgaaatgggagctggaaagagagaagggatcagagctgcaagcaagtacctctagtttgcatttcctgagctcctgaatgaccattctggttgtcagttttctccccagcttactttctggaaagtctctgacacccagaaaggcaggtggcaatttgtggaccttctgcttttgctcttggcagcgcctcctgtgattgtgttttctgggcattcatgcgagagctttccagcttgccccctttcccttctcctccagtttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactggtaggggggcttgggacgggaggaggggagggattcactagcacacactggcatgggagccagatggccacacgaaaaccaaagggaaacacccagatcctcccaactcctcactcccaggctgctagggtctggggatgctataggcagcccccacctcggccccacccacagactaaatgccacttcttgccacctccctttttgatgagttctgagtggcaagggactattctgaaagatattgacaacattaattgtgatactaatctctaagaaaggactttttataaagttgcatctagaagtgatctttattcatcaacagtgtctcttgggcttctactctgtgctctgtattctgagaaaaaccatcctgggtcccagggaattcccttccttttgggaagagtttagataaaaggcataatttcctgaccgtgagtttgtaagctggcacttcagaatgattttagaaatttgtgaagagaaagaagggtaagccttgtttttggcaggttagggacagtcctcccctgaagcagcattccattctgtggggccaggttttccatgacctagcttcggaacagagatctaaaaggaatccctgggatatatgtttgctagacccctctgtttgacaaagaacaaatcactatttctattttatggatgaagtagctgcaacccagaaaggccagtgacagtattttaggccactctagtgatgggaatttaaccccaatctcatctctttgtacagggtacagtccgttaccccatgccacccgccatggtaccatttacagcgtcgttttttcactaaacacaaagacaactgcctctctcttttaatccctaacgtcccttacctccccctcctcctccccctcccttcttcccctaaatagtatttcagcctgagctgaaagcacaagccagcccaaatcggattctgtctgaattcaacatctggaaccaattcggccagccccattgctatcgactgaggtaggggaggacaggggaggttgtttacttaattagaggccaattggtccacgcttctccctgacccccacagaacagcctcttgcccaaggagtgaagaaagtggcatttgtgttctgtgaacttagtaataccagtgacatccctgggttcatccctctctgctgtactgcagatttcagtgtctgggtccaagctggaggaacctatgctggccagctgggagagaaagctttttgtcaccgacagatggttggtggtgactggggaggttgttggtcactttaggtctcagcctactggatgatgagctccagggagctgtccttgtgcatgtgacttagagctttggttttcccccttgcatgagtggtgaaaagctgtagaatagcattcccttccttctaaagtcaggcagaacctccgccctcacttctcaaacatcaaaccactgcaggctctggtccagtgcccggggcacagagacccctacagccctggcccctgagtcccagcccagtgggtcagagtcctggaggggtgtggctcacggggacaggtgccttcctccagtttcctccaagatattctcccaacctaccccctgtttcttgtgcactcaacatttattagcagcctctggaaaaaccacaagattagtcagggaacattactaccgcagactgtgtgggaggctagaagcacctgaggaacaagagtcagcaaccttgggttgagagggaccttctaaccgctggattcacacccacctggaaggctcatggcctctcctctcccttctttgggaagtgagagaagtgccagccccgggagctaaggcagtaaggaggtgagtgagggtggtagaaggggagatagagcactaagaagagaatggagaatgatcaggagacccaaacagccatggaaaggagagcaccaggccacatggcctccccacagctgtggagaggagagacaaatccatttcaccacactttccagtcctgaaactggaaccggttttctaggactaccggctgggtggcatggtggactgctcctgagacctcaggtatttttgggtctggtgggtgcacaagagcaaaggctggggatggagtgtgtttcaagagaatcataggattttagggctagaagagacctcagaaagcatcctcttgcctttctcataaagcagtggttttcaaagtgaggtccctggaccaacagcatctgtgtcacaaaggactggttagaaatgcacgttatttggctccacccagacccagtgacacaggaactctgaagatggggcgctgttttttaacaagccttccatggctcgctgaagtttagaactgttgccttactggctggctgtgtaaataaacttgaagccctgagggaaagtttgcctttgaacctctcccccgccacccccaccatctcaaaggtttccagaacattacaaaattcatcagattcatcagatggtttttagccctagaaaacagtgagaaattgtgcctacattttttgacaaagaggaatctccgtttatattcttctagaatgttctctggagcctgggaaacctccttggaagtgacttgctctacacaggacgagttctgaactggtcacccagtctttgaggaacttcccaggagtgtaggatccatcccatggggaaagaggcttgagggttccaaggtggaaactgtgcggccaggctgccaggctgagtgggtgatggtgctttcacacaactgcctggaaagcctcacctgttactgcctactaccagaggaagaactttagaaatgaacagtttctctacttttcaggaagtaagaacttcctggtgcccatcctcatgagttctgaagtccatgagccaggagatcaggaatagaaatgactttcctagtaacctctctatcatttctcgattccttacactggatgatttttttttttttttttttttttttagacaggatcttgctctgtcacccaggccagagtgcagtggcacgatcatggctcactgcagcctcgacttcccaggcttaaccaatcctcccacctcagcctccagagtagctagaaccacagcatgcacactggcttttttttttttttctttttttgtagagacagggtctcattaagttgcccaggctggtcccaaactcctagactcaaatgatcctcccaaagtcctgggattacaggtgtgagccattgtgcctgacctaccctgaatgattttaaatttcatgaattatttcaagaacttgacccagcttctctcccctgccctccaacccataattggatcctgccctgtagcccatagcagattattcctcccctacttttgtttcccaccctctcctatgactcaccttccactttttcaccagttcacagtctgaactgcaaagcaacctagaggcatcaagcaaaatgagaaagaaggaaagcaagtactatttattaaacacccactctgtgccaaacttgtgactaaattactttattaaatcctcacacagctgaggatatagatctttatcttcagtatatagatgaggcagctgaggcttaaggagattaaataacttgcccaggatcacacagctaccaagtatcagagctggttttcgaatccagttttatctgatgccgaaacccagtgtttcccttccaccctgcttcccctttgaaaaccaggaatgaattcacatagagaatcagaccttgaggagttgagttgttctctattttctaaagaatttagtttataccttcaaaagggcttccctttgtcttgagatattctaagttccaagtagtctcaagtggtttttgtagcaggagctagactggaaaaactctagagctttgtatttcattataagcatttgtctattgtgtgcagttaggatatagagagcataagatggattcagtgccctcgcgccagggaggctgtatgaaggggaagacaagaattgtatgagcacatgttaatgtccctgtcactcttgcttctgttgcagtgatagccctcatggagagactacctcggttgaagactcaacccaggatgtgaccgcagagcaccacacgagcgatgacggtacgaggccctgcttcctggtcagtggggacgccaggggtgaggcagaaggaagcgattatatatcctgtgcatctgatgaacctgtctgcccagcggtcccctgagggcaggcagagagctccctgtctcaatttcatttccttccttccttggagaggtagcccaccttctcaaatagaatcgctcgtattaaaccagaggtgaggaactaggcctttcatagcccttcaaccttcttgctccacctcccagctccttgtctggcctgagtgcagcatgatgttggtcccttatcatagcctagactcctgccagacagctggagaacaaagtgaaggaaagtacatttgaaaaacagtaagcaattgggtgtggtggctcacacctgtaatcccagcactgggaggcccaggcgggaggatcacttgagttcaagaattcaagaccagcctaggcaacacagccagaccctgtctcttaaaaaaaaaaaaaatagcctggcatggtggtgtgcagcatccctgtagtgccagctacttgggaggctgaggtaggaagatcccttaagcccaggagttcaaggctgcaacaagctatgattgtactacagtactccagcctgggtgagagagtgagaccctgtctaaaaaaaaaaaaaaaaaaaaaaaaagtaagcctggggtgggaaatagcagagctggttgcccggaacccaatagaagcaagccagagggagtgggaatgaggatgcagaaaccacatgctttcacgcctaccgactggaaaaactgaccctttccaaagtacagacatgcgagtgccgagcagcctggtgggcgtgcatcaaggggaggaatgctcagctgtcatcctcaggcccctcagcagtgcccatgctttatgagggtctgtccagccagcacatttcccccgcttccaacagctccacacctcctctggatcacatgggctctggaagtctcagcagctgacaaggggcctcagaattttctgggcacaagaatgaaatggcaacagtctgtggagttttccctgttccctgccttgctgggaattctgcaattctaggccagctttcaaaggagaaaaaaaaaaaataggactgcttatttagatcctgatgtcataaggatccatatgatcatttgctacattcgaggaggggagtaggtgaactaggaaaatgagtagtgggttagagcctacctcgtggccagctctgctagagtctttatatatgttatctcttaatctgtagtgaaaaagatatggccgctattttacagttgagaaaatgcaggtcagggaggtcgagtaacgtacccgaggctgtagagaactaactgaggtgggtatatttagacaggccttctctgaccagcctcctatagtgaaatctccaacccctcctgtgcaggagcagacccaccagctagggccatctaggcatggtcttatttttaagcagcctttctctctgcttcccagaatagccgactttcatctcaggttccagctttctgggagccttctctttgctctttgatctctacctgcagcctagcacagacgaagataatgataacaataagtcgtgcacacataccacttactatgggcgggacactgttctaagcacttttacaaattgtaattcattgactcttcataacaacttcatgaaaaagacacgattattaatctccatgttacagatgaggagacagaagcccacacaaaaataaagatagattgcattcgtagaccccttttacttttttagattactttcatgtgcatttttttcataggttggtcacaaaatatattttcatattttgctccttggaaagttgattgggcaagttattttctctttatagagagacagaaagctcacattctacttactagggggaatggataacataaaatatttagaatacatgtatgtattctaaaaaatgtatgatacattttctacaattactggaattattatataattagaaaagaaataatgcttaaaaatatagtatggcaagtttgatgatagacgtcaaggcatgaagatctttggaaacaccaaagaagttactgtagaaagcaggggatgcggtcgggcgcgtggctcacgcctgtaatcccagcactttgggaggccgaggcaggcagatcacgaggtcaggagatcaagaccatcctggctaacatggtgaaaccccgtctattaataatacaaaaaattagctgggcgtggtggcacacgtctgtagtcccagctacttgggaggctgaggcaggagaatcgcgtaaacccgggaggcagaggttgcagtgagccaagatcgagccactgcactccagcctgagcgacagagtaagactccatcccaaaaaaaaaaaaaaaaaaaaaaaaaaagggatgcttgagttgtgttttgatgtgcttcatcaggcagataagagagaagaagattcctggtggagggaacagtgtgagcaaaggcaggtaaaaggtgataccagtgctttcaggataatggtatagtctgcgtgagaattacttgctttatagatcatccatggcttcgttttcccactaagtaatttcctaccactgtaagttcagctaattcagcttttccacccagtttcctgagtctgcaggtcccaagaacatgtgtttacttcttttccacccttctcagaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgtacgttgggcccatggcatctttgggggtggtccccagctgctctatgggaatgagacttcatttctggagccataggactatgagggaggccaacccctcgggggtccagtgcagtcctgaggctcacacagttccttgaagagcagcccccccaccccccgccccactccctgcactcagtggagaatttttttaaatctctccactatctgtgccccctgcaaatcaccccctaatccagtcattttagaaacctgccagccagccagcactcatccatatttatacctgatgagtgataacaaggggtttttatttgaccacctatatttcttttctcgaaagatcaggctgggaaaacatttttgttactctcttttttttttaaacaactatgctcaccccaacctgttgagccactcttccacttgcaaattaaaatgactggttttctaggagaaatccggcttaagcagccttatggaagtgacctagttcatttaaccgagatgaggttgatatagggtaagatgggggaaggagggaaaaggatgtcaaggaacaaaggaaacctgaactggtcccagagagatctcatctgataggctgttggttgattctcacactttgaagcagttgtcccgtgggcccacccaagcctgccccctgtccgtttgccctgtctctgtccccagctcccctcccttggatacgatgctgtcagtgtttttagtccttcccttaatattattttttaaaggttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggagggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaaaaaaaagagtatctgtagacagttaaggtggttcccttgaactccttgtttgctggtgtcaggagtcttgggatggggttcttggaggacaagcctcatcacctggtgggtgggtgagcggtggccccggggcatgtctggcccttagaagtgagtcggcctttgagtcttacctcctgccccccacgccactcctcctcccaaattccttgagtttcccgagtgcccaggttctctttcgcccctgggcgctcacgcctgctgtctcctcacctggtcacctcctcatctcccttcaagactcagtccgaagacttagctctttggggaagccattctgacatccctgacttccccaggctgagtgaggtgcccttatgctgcattccaaagacactttgaataccttttggtactcacgcttcactcagatcccccaccagattgagctccttgaacccaggaactatatcttccttttctttacatccccagggcctagcctgggacatggcacaccacagccaccccataaatctgtcttctcagcagtttcagcccatgagtcagctatcctcaagcagaaaaaggaaatcagcaaagagctattagggtgtggcacttccatttaattctacacatttattaagtatctactgttgtgccaagcactgctggtgtttattcagagataaaaaagacgaggtccctgatctcagagctcacagtctggcaaggtaaagaccctatggacaggtaactgacaggtagcatcagatgctctgaaggtacagaggagggaggggtccattcttcctgcaactggagttagtggtgcagtggtgccagtgcagttggagttagtggtgccagggaaatccttgcagagagggggttcatttcagcagggccttagaagactctgagaacatcctttttccactcgagagcggctgagtcacaagcctaaaactgccgagtggacagactcacggagtgactgatacatgccaggtcctgggccaggccctgcaggcagaaagatgaggaagacctcagcagtgaacaggactaggactggcttagagcactgtccccacctcacagaccagctccttatcttcagagtctaaccccttccctccttccacctcaactcctgcctcagcccccatctctcttagattcaagatcagagctgttcagcagccatccaaatcagaagtttcattgcctcttagattagaccttttcagatctgattccaagacaaaatgaaattatccagcagcaggcaacacccatgtaactgggattctgccaagccattttgtctgagagccctaagtggtctgaaacaaattcgcccagatccagggttcagcccagtgctgggtgacttgggagtcatgtagaggtatttccacactaagaaaacgcacaaactgggccccaactctgcagtgttgctgcctcttgaaaactattctgctccatgcctacagaataagcaacaacagcctcttgccagagcccaaaacagttacagtctgtttggaaaaagagtcatgctaaaatttagaaaagttaactatcctcttaccagcaatcttgacctctttggtgatggtgagacttcttctcctagctggggccttaggtttctgttcatggcaggtcacagaaggggcctttccatgaatctctttcccattagaaaccttcgcttaatcagacattttttctgacagcaacttacatcttgacaacacaaagcccgtgaccaccaagtaagtatccatttctccttcacccagcttgggggtggcaagggaatgaagacatggagaatgcaagagaagatgaagccgaggagagaacgagttctgtgtccctctccttccgaagtccctgggtgccaacatctgccccctcccacttatcctagcttccttggagccagggctccctgatcacactgccctttctgtttgtgattgaaggcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggtaactgtgggctcctggacagacagcatgagtctacattcatcactaccacttagtgccacccacctaattatgacaggacttgaaacagaatgattattttgtatgtgatatactgagtatatgtccactctggacatgtggacccaataagacagcttaataagtggtctgcctgtccctctctccccaggaagaacctaaagacagaataaaagaagcctagcttcttgctcatacactggctattaggaaggctgttgtaatttttaaagccggtattaagagtattttgaaagcccaagttttgagtctaaagaccttggtagactttagtgaaactgcccgactgttgaggatcaggtgtaatcctggccacatgtttatattgctgtgcccatcaccatcatcccgattcctaaggctagtctctggtaccgaatgggtagatgatcaattaagaacctgcacctggttttaaagacctaaaaaatactctggctgcagagagctctggtaaccaaaaggatttgcagcccaagcctccagaggctatggagatgagctccctggttgcagggtcttccttctgtgtatgcaccgcactgatgactctctgttttccatgaaatattagagatccaaccccacctctaaaaatccgactaccggggccactccaagcagttcactcagacgtctctcccaactatataattttcattagaccaggtaggaactaagggcttattgttgccttcttatctcaactgagttgagattctccttaccccatcttccagggggtgatagaggctgggcatggtctctcttggcttaattgtggttctctgcttacggagatgtacctggcaagcccagtattgagctacaggcctgagatgtcttgctttgctagccttctattctgtgcctctatttaagctcttggctgcaatctaccttgcgctacgggaatcctcccagctccctccttggccaggtgttaataggaatgtcaggaaaggtagacagctgggacagactagctgtagagtgcgactgaggagggagatggagttcttcctgagcattttaaaggtttgagaatgtcatagggatgagtgaaactgaatcactgtgaacagaaagcatgcatcggtctgtacgacaaagaaaccttaaccaaaggccttcgcttggaatgtgtaaaatctttccatgtgaacctaatcccaagaagaaatcctgtggtagtttgggggtgccagacacaggtttatggggagggagcggggagctgggaagtctcactggaaggcagctggcttgcatacaaaggttctttggttctgccttgagtccctgggctaggactgctgttggctaaagatctagagtgttccattgatttgcaggcaattgattcacctatgtgggctttggctccccttcctggtcattctttggtccccttggtggtgatggctggaaggaaatggtttcaaattggacactgccctgagttggggaggaggggcggggggaggcgtattgggctcctgaaactttcctcagcccctgaggaggaaggactaaccctcttcacctttggccttgaagtccaagagaataaagatcatacatcatctctaccactttttaaaaaagtgtttattatgtacaatttcaaacctacccaaaagcagacagaactggataacaaatccccatgtactcatcaccaaactcctggccattcttactttgtccgtgtttctcttccccactagattatatgtcacttcgtcgataagtatttcaatatctatctctaaaacctagggtctctaaaaaaatatcaattactttttctaaaggaaaaaaaaaatctcatgacagtgaaaatccctccgtccccctttccctacttcctgagcattcatatgttcaaagatttaggccaagtacaataatctggacatcttacggtcattttcttcatgccttggcctgtgttgttgaaaccggctccttggggaattctcccctcatttgcctcacctcctcctttttcctgttttgcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacatatgtttttctagtctctggcatgtgtagcctctcctggtcatagaccagtctctttgtaagttattgtggcagttcacacagtagccaccaggggtctctgtttccattacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggattttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcgatgctgca

SEQ ID NO: 443 - DNA, 121585 bp, Homo sapiens; identical to SEQ ID NO: 442

SEQ ID NO: 444 - DNA, 113307 bp, Homo sapiens
ggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcagttatttttctcttttgtgtgaacttgaagtgggtgttgtgaaacacccatttttcctttccaggccttgtggagtctctgggtgaagatatcagctgggaaagggttaatgagctatcaactcaagtcatcatacatctggatgggctgtcattaacttcttacaaaaatttgatttcccctgagagatttttcatcaaacatttatataacccagaaatggccaggggagtccagcgtggccacagaactcatcagaagccatggaaagcctgctttgtccccactgtgagcaaaataatgtgcttcctgtacttactgggattcttcttggaacaggatgaaatattcaaatctcatttacctaaccttgccagatattgcttcttcgctgaaggctcggtttctggctgtttcccctacaggtatatagatagtcaagactctggagaacctcttccgaatctgcctggttggctagaggtgtagaggagccaggggcacattgtgactcagaccctcactcattggcacaaagaagctacagaatagttatataaacagaggcagtgtgccagcctgggaaaactcccagcctccctttggccatagagtaagcaaaacaaatggcttcactggccccatctacccacttgacttaggtcagtattcagcctaaatgttttatttcctgagaggctggaatctgtatttgtggtatcaatcagtcaactgaaatttattaaatgcctgctgtgagcaaggcctaatgctgagggatgtaaagaagagtgagaagctagtctggttggggtgatatgacatggcaagtcatagaatgaagaagcgtattccttgtcatatgaaagctgtagattagtgtgtttctaagtagaggccagggtcactggagtctaggattgcagggttggctggcttcccagaggctaagaatttaatctggatcttgaagatctggtccaattccaacaggtgagaggcataggaaacatttaaggaaaaggacattctgggagctgaagggcagaggtcagtggatttggagctatattagtatttttttaaagtgtctacatggtaccaaatatctgtaaatatattgcctgttagcctacaacaaactgtgtggctggtgttatcctcatttgaggcccagaaggattaagtagcttgcttatggccatatagctgatttgaagactaatactctaccctaaacagagagtatttcattggattagagcagatgaatctgaagaagaaaataaagggagttgatgttggatgggtagattgaagacagattacagtttgttctggctattgaaccttgctcaaattatttaacttcactgaacctcagctttcaagcctggaaaattaagattataccaacctcattggggttattatgaggattaaaatgtagaatgtatataaagcacttagcacatggactgacgtatagtaagcatacttagtgaaatagaagcattttttaaatttcaaaactgaggaaggtggattttaccttggggaaaaaaaatgagaggtattttaggttcttcaacaggaaagtgccataattaaagtcacagtttaggacagtgaagcagacggtgagggtatgaataggggtagaggtagtaagaatggagaggaaagggaaattaccaaaaacaggtaaaagttttttgaagggtaacttttctctcccagattctaccccctgcccacaccccctccacccacactcatacactctgtgggccgtgttacttctgttcattagacttataggcatagagctcatcaacagggtctacatagagctagtcaggaaggtttacaggttcaagggcagcctggtgagaccagcagcatctcccagagagcccatgcccgtgcagagtcctaatgagccgcttttgtctagcttccatttgctcttccctcccaactgaatttaatgtctttccatcctctgcctctagttaagttgtaactgctgttattccactgcagccaggcagctgccagggcctgttggcactgaacccagagcccaacccaactgatgttctcactgagcttcttgtcagatgccaggaaagaggaggcacatcatatgccttttcttccccaatagtagctgcttccaatgtgatcatgatgagaggaaaaggctgtggggagagttaatttgatgcttgcttgtgcaatgaaatggcaatcaggcagatggccttactctatgcatagattcttctttgaggtttcttctcaggacccggacctcagagctgcttaagcaatagagaagatgatggatggccaaggaattgggatctctgggtcttttgggagggatggggaatattatcacagagttacagaatgccattgctgaagagggccttagggattacatttagtccaaggattttcagacttttctctaacagaagaattctttcttcaaaccaaaccttacatagaatccctaaatattaaatagaaaaaagagcagggttggcttggttgaaggaggaatagaagactccaagtcctagtagttgggttgtccttttactcacttctcaagggcagcttcagtgccagctctggtctactgcttgaaagccactagcctggccaaatctgttcattttactatggaagaaacaggtccagagaaggggagtggcttttccaaggttgcttgattctgcgccagtgctttttttatacagttgcctctttttgcattttgttgtaaaaaatcagaatcctttacatggcatgaatttttccagtaacacttttgcgtagagctttttagtcttataaatgctatttctgtagtgcaggggcatctgttgtcagatgccaggaaggaggaggcatgtcagaaaccctagtctgcagctaaggcctgtcctaggatgttgggcattggtggggatgatgacccacagagtcagctccccattctctccttctcccatctagagttgagcttgcatacattagctgctgttgcaatactcctgctttcagaaccctgaaatggcctggcttggttgctatatagtgatttaaccacagtaaccctcagtgagtggcaggttgtatttttattgttgaattttgttataatgacaaccccagataaacctgaaaatgaaagaggattctctttaactctcaattcttctcatgtttatgaagtagcgcttaattaaataatgtcattttatccttatgaatcttcttcctcctaaccgcctcacagccctctagggtgtgtttaactgttgaattgggagtcaagaactgagaactctcacccagaccttggaagtcggaatgtcagccctctttctactgcacagccaagcctattgatgtggtcagatctgccctctggaccaccttccttttctgccaagccttggggctgtccatggtgtgctcatgtgccttctccttcccacagcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggacttgtctagattaattacacagaaggcacattattctggggtgggagaggcctgggcccggctttttgtcaggtgggtgaggcacattccacttattgagcaaacagttagtgagtgcctgctgtcagacactcgggcttgggtgcagacatgggggattaaagccctcagggagcttacagtctggggaataaggtcgctaaggcttgaggagggttcaaactatgcatagagaggggtatccaaaggggcccagcaggatcaaagaaggtgaaaaacagcaggtatattctaaaaactaccaacagttcaggatggtgaaaggaaagtgagggaggggggcgctcccagtggtgaggctagaagaaatgagagctgaggtggggccacatcctagaggctttagtggggaagcgagggctaggcagggaatgctgtgatcttttggcatttggcagagttctgaataatcttattctcctgaaattagaagactgtgatgaagtgtatagtttgggtattgaataaaaaagaatgggtacctgcaggaaggaaaggagctaagatgctatcccaaaggcctgatgctggttgcccagacaggggagcatgaacatgggggccttgttttggactcttagcctccagtgactagaataaaaagggcctaaaaaagctaaagtgagaggcaggagaagctcctcggttttcattgttctgaatcttttggttccacttgtgtggttgtgtgtacaagtcagagtgaacctcattcctgtggataagagccaccatttctcctactggtgaaattagaaggaggttgtatagggcttatgcaatagaaaagatcaagatggacctttgggtatagttggctttaggaggaggaattttaccaagatactgttttgctgtctctgtactacttcctgtgtgttaactccattctcagacaggccattctcccatggaggcaaggtgactgcatttccagccttccctggtaggttgaaatctagtggaaagagtctctgcctccctcctcaaagcccccataaagtttgtgtgtctcattggttttgattgggtaaagtgcttatgcctgggtccatgcaaagcacgtggcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcctggggaaaatcaaaccatttacagttcatttccattgctgtggcttaggaaatgtcagtgtctgaacagatggagaagtgagatggcagcatgtgcaattagaattgggggaaggggtgtcaccaagcctcaggaagccccattcctcacctgccctggcttctggtcaaacttgccttccaagcaccttctccagctgtcactgaggttccttcccagggatcagtggaacttggggaccagctgagtggagtgatacattttctggtgttagtgactgagttgccttctgagccaaacagcttgtctccataaaggaggaatccagatgctgggtgctcaagccccctcctccccctgtcagagccttatttccatactccagagtgcagctgaagtgtattaccttgcaccctggtagcggaccactgccaaagcatgcatcatcatcagctctgctacttcttaaaggaacaggcttggaggtggtttttccctccatgattcctctctgctaggtctgggttactttaaaaatcaatagctcactcttctgccagggccctccctttatgtaatatagctgatcagtggctgagccaggcaggggccaggaccagtcctggagcttgtgaaggttccgcattctagcctagccttcatatgagtgaaaataaaaagagatgagagggtgggtcattcttggcctctgcagccagtctatccccatcagtgtgggttgtctgcagattgtggaggcaacaggagggagctgcctggaagtcgttgaactagggccaaagattgggtagcattttgaccggaagccttaaaattggccagggtcccacactaactggtgttctggggtgcacagcacatgaattgatgccaagtgctctcagatgtactaggaggaggtgcttggctccatttttggtgccctcagaggctgtgggactctggatgcctgactggtgacatcaggcagccagagaatttcactcttggcgctaaccggttctggccactgagctttctccattgtgtctgcttatccaagagttagagtgaagtcagctctctgtggatctgagagttggctcaggccagcctctcagctgggggaagaggtcaagtcagttgggagcttaaaagccaatggaggaaaaggtcaagtcccagccccctccatttgaagaaaggttttttcttttcaagcaagggaatggtccgtgggcatgtgaatgtgcccactctttgctgaggaggaaggagaccatttctatccagatgtctctctgcagacaagaggctaaaggacgaacggtaacaaggtgacaggagctgtctccacatgggtcctgcctcccaactctctcagccttctgctcctcatctgtcatccaggggactgtggatgacctcatcccataaccacatctccaatgggagacagtggaacagccattccttcacacaggggaaagctaattggcaataatccttgcgggaaggtcagactcctctcttacagatctagggaaggcctggggtaaaatgatggctctttggaaaatgccaagctccttcagattccataccccctcgggccctctagcataggcaacgaacttgttcctggcttcacgctttctcattgaatcaaagctctcatgcatggcctggatttgtaaacacatgctggctgccagcagtggcaagttagcctcctgacccacttctctcctgctttcactctggtgtatgaagggggatgagggaggggccagagaggtggccacttggacctttggcaggaaatcttcactgtgccaaagcattgtgtttctggagccggagctgcctgaggcactcttctccagcctcctcagccttccatggagctgcagaccctacatagacctacccctgccgggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtgagtttcttccttaggaggctcaaagccacactcttagtttccctgttgaaacttttgctgctgcccgtctgggagcaggtggaaggagcatgcagagaatgtccgggcggccgcaaacatttcctagccaaatgtaggcttggactttccccctctgctacatcctgcccttgaactccaggaagttgctcttgcattgccaaaggttgtgctctattttgagcttttgcgaaatgctttttttcccctctacacatttaatcaaaatggcacttggcagctgtgtgaacaatattgtgtctctgaaaccacctcctcatgcctagctttttccagcatgttcaaacaaacagaggcctttgactttgacacttcaaacatctccatcctcttaggaaagggtgagtttcttctgggctcagtgtatttgctttcaaaaagcggttcaaaagggcgggtgatccagctttctgttgagctcagatggcttcttaccttgtgtctcagtaagtcttactttctgcaggaagatcaggaagaagtagggataggtcacttagtttgcaaatgagcaaacaagttcatcagtttgttgaaggtcatgaaacagaacctggggctttgcagtactaggcccatcacacattttaattagctgtttgtatgagggggttggtttagatttattttattctctttcccttaaaacttctattataatgttgttatataatattataataatgctaatattaaattttaaaagtaaacattaaaagatctgggtcaagtacatagcatgaagggttgtagtggcttttaggttttcactgtagagagtagcatgctgtagcagagtccatgtgatgtttacctcccacttagcactgtccagtgggaagcagagctgcacactctgatggcatcctgtggccttccccagcccactctcttcaagcttctccatcacctgctgtttaacaacccacccttcatgcatcctgttggcccttgtcgtggcaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcgttgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaaggaaaaagaaggaaataaaaattttccataattctaccagctagagataatggtgttagaatatattcctttctaatctgttttctatgcatgcacaaacacatatgtgagcacatatttataattttattctaaaaaataggatactgctgtacatattgttttacaatctaagtcatataattataatattctttaagcatatttatgagtaaaatattaaaacctatacaaaaaaataatagaatggcattttagctcattcattgatttttgtaaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactgcttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgttttctaaattgacctttagtaaaagcaggaatggccatattcaaactggtaacctcgcaaatcctgcccaccctttcactttctgtctcaatacattgatgtcctctaacccatttcctgtcttatgtggctctagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacagcttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaagcgggtgggtctcttgaggccaggagttcaagaccagcctggacaacatggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaagaaagattaaaaaataaataaatctgctgggcgtggtggctcacgcctgtaatcccagcactttgggaggccgaggcgggcggatcacctgaggtcgggagtttgagaccagcctgatcaacatggagaaacctcgtctctactaaaaacacaaaaaaattagctgggcgtggtggcgcatgcctgtaatcccagctactcaggaggctgaggcaggagaatcacttgaacccgggaagcggaggttgcagtgagccgagatcgtgccattgcactccagcctggggcaacaagagtgaaactccatctcaatcgatcaatcaatcaatcagtaaatccagagaggatgggtagctcacaaaagctggacccaccactctggttacagggtctctggccacaggctgcttctctacaccctgtggaagaagcagaggtgaagggaagggctcaggaacagctcagcaatttttgcctcttatttgccctcagtggtgacatgtttcctgatcttcttggctttgtgtttatcgcttatcttttataacacatagttcatcaatgtctactttttacccgttgccttttttattgtgattgttaaaaatcaatacttttaaaagatgcaaagatttgaaaagggtatacaggaaaacgtactataaagtttcttttcattcctgactcctatttcccctcccctctgctggtgattgaaaccagtttcttctgtgtccttccagagatactctatgcatggacaacaactgacgtatctgtaaataccctttaatatgataaattacattagaaatgtaatgaaagaaaatggaagtagatatagaagtattccacttatacagttcttcacttttttaacgttctttatcttggatcttatttttatgttagtcccaaaagatctgcgtcctttttaaatggctggatagaattccactgtatgaatgtgccatcatttgtttaacaaattccctcctcataggcagtgatgctcgctgtttagccaaggtttaccaaagctttataaggctggcattttcctaagtatttcctttgttttttggaaaccaagcctcggctcttgttgcccaggctggagtgcaatggtgcaatctgggctcactgcaacctccacctctcaggttcaagcagttctcctgcctcagcctcccaagtagctgggattgcaggcacacgccaccacgcctggctaattttttgtatttttagtagagacggggtttcactatgttggccaggctggtctcaaactcctgacctcgtgatccgcccaccttggcctcccaaagtgctgggattacaggcgtgagccaccatgcccagcctaagtatttccttttatagggagttggagaattaggttcttttatgggggatagaacagtgaaggggttaaggatcatggccgataaagtaacaaagctaaacagtctgaattcttagggacaggtttggggaaggtaataggagaggaggcaatgccttggccactggggcactgagtgacactagacttggaacttgtggtctgagatctttttatcttggtattctcttgcaggcccttggtaaacgtgtgctagtgagtacaaatgagtgaatgcccctgtgctgtcaattaaactggggagacatgctccatttaaagtttactctattatgtattctatctgacagctgtttcctattttaaaaattgacggggaggaggggaaatgtcagcatgcctgcatggtggggaaacagccactatagtgacatctgtgtatctctgagcatgggctgggtaggtgtactcactcctcctgccttgctgcagtggatacttagggtcttgggttcacgcagattaaatccaaggcataagcaacatccagtgagttttatacccccatggtaagagtgtatttaaagggaagaggtttttaaaaatgaaatttgaaaagcattctagtgcctcttactacttttttaaggcccaaaaccttctgctttcattctgcttttattttagcacaaagcaaagatgcttagggaagggatgcttttaggttcactgaggaggtgattcaggtataaaggaacacctttctgagtgcctgctctatgccaggccctgtgctattaacagtaatgcttattatccaatttcattctcaccaactttgtgaaaaaaatagtattctcatttttcggatggaaaaactaagactcagggggttaaatgatttgcccaaggttaggagagttagtaagtggtaggactagaatattccaactcatgctttttcattttaatgcaactaaaacgtctatcaaggagggaatgtgcagaaagaaaagttattatgttaatacttttcaataaacaaaactcactgctgacagttaatatccaattaggaattattaggaaatcaattaatgagatcataaaaactgaattgaagtttcacaatggcactaaacaaaatgcccaatagactctttgcctcccttcctactttttgaagaaattctcagttttgattattttaagtgtgaaagttgttgggggtgggcactggtcagactgtgttttaggaacttgattttattttggtgaatacctagaataaaatattacctgttcttttgctccttcattgaggaaaaccccaggtagccactttgattttgggtgtttggtgaaggaaggaaaaagaactacctaatattggaacatgccctaagtaaggagagtgatcctcattgcccaaggaagggattttgagattggagattataagcagcccttttcctggcccccctgatctccagaagtcattaaaagccacctattcttcccttgcattcttcagcggtctcagctcctttctctgtgttgtctgtccaacagcaacagaaaccttctaactcacttccaccaattaaagacaaggtcacttatccccaacgagtctctcatatggataagtgctgacttgtgggtgggataggggagtgataaataaaataacgtgcctgcagactctgagatgcctttacctttccatacctggcttacctggatggaaaactcccaactgtggtttccacgccagtattagggatacagttcataccttgacacagttatgatccttcaggatttaatgaaacccgaagaggtaatccatcatacatctttaccagattgttatttattttaatggttcatcaagtgatagccagagttaactaatgaattgtgaacatgaatttaaaaaatgatttctggaatcacaagtagtgagaggaaggaatttgtatccatctcctttgagaactgtggctgttttctgagcagtctggtcttgttttgaaggttacagcttcttggtgaattttcctcattaggaaacctttagagtctcctgggataaccttccaaagagagaggcttttgaggcttgcattgttggcaatggatatttcctgaaggctttccacctctgggccctaaagtactgttccaaacccacaattaggcattggttggggatttggatattaccccgggaagaatgacagcaggtgagctggcatctggagcagatggaaaagggaaggtgataacagagcctctttccttgcagaagttcttgtgcaaaagcataaaaggacagagggaacagatcatgaataaggcagtagaaatgatttggtgtaagatttggttttggcttgttttatttttaatttagagagtacgggcacactaggggcttggtttgtaactgctgaggaagggtctacccagaggagagtgagactgctcattcatttattcatcatgcatttattgagtatctgctatctgctaggcgtggtagtatcagggatgcaaaggataatgaatgacatggtctctgaccatagagaggaggcagtctgaagaaaaagacacatgagtaataaaccctctgtgacagggctgtatgagaagtgctgtcatggagatttgcatggtacacacaggaccatctgggtgaacatgggagggctagggactgcatcccagagaaagcagatttttcttttgtttttaaacaagagagagaatcagatgcaagctcttagttaaaagttcacactgtacagaaaagtatagagtaaaagtaactcacatttgttcacttttcttttctttttctttcttttttttttttttttgagacagagtcttgctctgtcgctcaggctggagtgcagtggtgcaatcttggctcgctgcaagctccgcctcccaggttcaagcaattctcccgcctcagcctctcgagtagctgggattacaggcactcaccaccaccatgcccggctaatttttgtatttttttgttagagatggggtttcaccatgttggccaggctggtctcaaactcctgtcctcaagtgatccatctgtctcagcctccaaaagtgctgggattataggcctgagccactgcacctggctctgttcaccttctctttctatcactcttaatcctaagtggcaatccatgaaatcaaaggtttgatgtataattatatgttttacttaatatacattaaaagacagacagaactattaccatttaaaatggtgcatccacctatctacctcagtgatctcatatatcaccagtaattcacggatcacactttgggaaacctggccatttgacttctgagttcagacttaggcagatagcccctgatctggaggatgaaccactgcagcaggaggtgatcaaggcaaactaagacccccaagaaaggctgtggaggagagcggaaaagatactgtgttaaaagtccaaaggccttagattgggcctgacactaccacttgctagcttgcaatgatcagcaatttatttgatacctcccctcccctgagataatcttatctgtaataaggaaataatatcttccctatgtgccatacagttatttattgttagagtcgaatgagagaatatgcggtgaagtgctctaaaacctgctatgttgctgcatgcataaagcattaatactacaaaatttagttctgcttctctccttctcctgctctgtaccatgatggatggggcattttgtcgtaatggttaagagcacatgctgtattgtcaaactgcctgtatttggatactaactttaccactcactaactgtttgaccttgagcaacttaattaaactctcgaaacctcagtgctctcatgtgtaaaatggaaatgatgatgatgatgatagttcctagggttgttttgaagattcagtgaattgtctggggacatacggtctctcactgggcagacgagggttgagagagaacaaatctgaaagtgcagcacagcaatcatattttgactgtgagagcaggtgggatcacatttccaaaacttcatcttgtatttagacctggatgtgtgtatgcaagtcggggatgtcagccccttccgctgagtgctcagaaatccgaagctttccataaagactccatgcagaatagagaaggaagctgttgaggatatggctcaaagatgctccacatcctgggcttgcagctgaggcagggactgagcctgccattggcactgctcctggtgtgatggaatgtccccccctcctcccaccgaggggccagggcagggtgggatgtcagtggaggtgacagatagcaggtgtgtgtcctcacaccaagaagaccagggctcaataagttcatctaccctccctgctcttcctcagtgaaactgcaggagaggggctctaggaaacaatttctttatactggccatcatagaactcccagaaaaaacctggagaaggatattaatccaccatgaaaatcaacagctgcccatatgatcagtgccttaaagaaattaaaaaattgactggtggaaattgggtcagaaaccaaatgacctctatataggggaattgtccagctgagcatctgtgatttttttcttcttcttcaggagtctgattgctctttttcctcctcctctcttacagaaaatgaaagagtacctggagggcaggaacctcatcaccaagttacaagccaagcatgaccttctgcagaaaaccctgggagaaagtgagtgtgggaaccctctgctagaggcttgacagtgaggccagctggagctttcttgctgagcacacgcctccatcctcagccaagtggacccgatcttgttgtatgaatgcctttcttttcttggcttgttggatgtggaagcacacaccccaaatgactgcttgagtaatggggaaaggccaatgcttaatgaagcactaacgtgtatcatctagttgtttaaatggagcgtgcctgctctccacccagtccctccaccctcgcctcctctgccacgactagggtagagaggctgaggggttatttattctccagacactttgttaaaactcctagctcctctgaggcagcactgagactggagcaagaaggtagggagctgtgagatgagatacgcagctgctctgagaggagagaatcctcaaatgcaggagggatggacagactgctgctttctatagcttccagaaagagcatcagtttccttctgctttgaaagctcctaatgctgtttaagtggcagccctctctcgtgtggctatgctgaggccttggtgctgaatggactgtcttgtctcatagaatgattttaaccagaccctggaaagtagcaaggcagagaactggaccggcactctggactttctctcctcaactgtcaaacagaaggtggaggttgaaagagaagcttccccagggttttttggcaccctgcccagatttcctgcccaactctcagcatcctatgattaatgggattcccaggttggggatgcctctgaatgccgcccccccctccctgccccactaatctaatctcctcacttaaagataggagggagtggaagggagaagctgcagggaatatgtgctaacatcagttacaggcaagcctgtacttacacagagatctgacattttaaaataaattcttgagcactctttagacaaactgcaaagtttaggaaagtgtgcaatactccttggctcattggccccaggaattggagcctcacttcttattataccagaacctcctacccaccttttttgccctgtccttttcctgccttggatgatttcccagatgattaatttttttctctaatcttttatctaatgacttcttttttttttttttttttgagatggagtcttgctatgtcacccaggctggagtggagtggtgccatctcggctcactgccaactccacctcctagattaaagggattctcccacctcagcctccccagtaactgggattacaggcacgtgccaccacgcctgggtaagttttgtattttcagttgagatggggttttgccatgttggccaggctggtctcaatctcctgacctcaggtgatccacccacctcagcttcccaaagtgctgggattacaagcgtgagccaccatgcctggctgatcttatgactttttttttttttttttttttgagatggagtcttgctctgtcacccaggctggagtgcagtggtgtgatcttggcttattgcaaactccacctcccaggttaaagcaattctaccacctcagcctcctgaatagctgggattacaggtgcccaccaccatgcctggctaatttttttgtattcttagtagggacgaggtttcaccatctgggccaggctggtctcaaactcctgacctcaggtgatctgccggcctcggcctcccaaagtgctgggattacaggtgtgagccaccgggcccagcacaatcttatggcttttaagacattttcttttatgtgaagaaagctggttagataatttctattcttcttcctcaccaccgaaaggactcagactaaacaagtttgggcattgagggccaaactttgcttatagaaaatctttactcttgggttatcacatcactccatggagaatcaagacagtctaagcatagtccataagtaagacagagagcagggccttggggccatacaaatgcattcatatgcgctcacatttgtgtgtgtgagtgaatgggtttactcacacatttatgcaccaaatgtgctactatggagggatgaaggctgatcattagtgctgcaaattgtcttaatctaaagatgacaagttctagcaataaagaaaaaaaaaagctataaatctttctgtgtgcaagtcatcacgtccctgccttctgaatgtttttgtcaccatgatgcaggagccccttgttcttgccgtagagggataattgatgtgtatgaatattccagaatggaaatggaacagatgtagaaaataatggctcagaataatatttttgcacataagagctgagcctttggtaacgagagacagttaggggtaggggatggcgttgctcaagatgagctgaactgtaagcaacaattaccaacctttaaaggcaagaaaatgccctgccctccctccgccagcccttggagttgcctttgcaagagcttggatagggaggagtgtgggagctgatttttacttcccccagctcagcacctgctagggtttgcccctggtttaaataatgcagatctaaaacagattgagcttcattaactgtggtcctaaagaaagcaatatatattacatcatttcccatgtagacatgcatatatatttttttaaaacatgagaatacttctcatgaacttgaagattttcagtttcatttttttaaaagctagcaatgacccattaaactcctaaggcccactgttagattgagaaccatgatttgctagcagtatcaacattgtatctcccatctcccttgccacctcagtcaaacctaacaggagaatttactatgaatctaaagctagaatatccatatcttctctgttctctcccgcaaacaactcctcttgttctctcagcctccaactctctgtgtgtgtgtgtgtgtgtgtgtgtgtgtgtgtgtgtgtgtgtgtactcaggagcaagtaaacttggccttccaccccaccacacacacatccaacataagagaagctgaatttcatctctgggagggcttctaataatttattctattaagtatgatctgtgctgctattgttccactacctccatctctatgttcccattgggaagcagaattggccctaaggtttagggggactgacctggactgggaatcagcatcagaaacagtttttgcccagaaagagggtcttggtgctttcttttctttctctctgtctctgtctctctctgtctctctctctctctcctctcttttgccacacactgttatactgtggctgtctaggggagataggcatggtagttactaggagtgggtctccctccttcacctcttctcctttaacataatgctttttgcctttgtgtttccaacaggtcagcggacagattgcagtctagccaggtgagtgtggcctgggacaggcctgggaagtgatagaggcttggtgggtagagcaatcttactctgggagagagccaaggagttgagttgtaaaggcattgaatgactttacaaagcaatggcctggggcggggtttgtttacttccctttgccttactgaccccatctgatctcagatagaaatggggttttctgggactttgagaaggagctaagcagaactgagtaaaaggggttatcatttgctgaaattgtcccagagaccccctaacgccactgaattgcaagtaacataaacattcaactgtagaggattctggtaacctaaccttagctgctagacttcaacataggggctctggggagtctctgacccagagaaagaagatcaggagatggcatttgattttttttttttttaatgcccagaaaagaaggcagcccctaattagtagtgactgttgctggataatgaaatattacattgcattggctcgccaaagagtattggtagaaatatttgcctgatgtacaagtatgcacccctcccaatctttccccaccttccccttcctcctccaccccagccaaatattttccctctcagtcatggtgctgctatgagaaaatttgtgagctgtcggagagcaaggtattcattcatccagcagttctcagatgcctagaaatgtgctgatttaactagagaaggggctttaatgggttggactccttagagaccctgggttagcccattatatcaaccacttatatctgccaaaacacataataattatgaggccatttacaattataggttcattatttagagatagcttcatttggctttcattgttttgtcattgtgaattacaataaagatcccattaatataccagtcttgatgactggagggaaccaggataatgggattctctggaacacatctttttggtgttagagtcttactgtaagttcacctgagctcctgagtctgtggaaggctctgtaggactgaaaagagctgagttgaatttcccggtgctgagttattttgctgtgagaccttaggccgctcttttcccctctctgaactctggtttcctcttatagaagaccagagcactccactagattcaaggtgtcctaggattccaaaggggttcctcaggagtggcctggtggcaggggcagagcgatgaccagcaaccaggctctggtcccatccttcactcagagcaggacagccctggcctccttggtttgggtgttatgcctctgagtcagattccctttgagaagaggcttctgaggctaaacacagattggaaaacattgacctagaggattctcaaggttgtttccaaactagatgttctacactctaaacccagaaaaattgttccctgtaaagatagcgatctttaaggatttcctagagaaacaaaacaaaaagcatcctttggtgtttcccagtgtctcctagcaggcaaaaaaatcttcttattgtctagcccaaaaatattttactaaaaattgaaccagtcctctcctattctaattttgagtagtggtagacattaaaagcagggacgtctgtgcttttgtgaaaaaaaagagctttcgtaggctttattgtggaagtaatttatcaagtttcttagccatttctgggactgaactgagtaatgtcacatgtttcattggctaccacacagattttttttaattattaaaaactttacttctgggtttaagagtgattgtttatctcattcgtcccaattttctctttttctcccttgttgctggattggtccaatctgattcggcgggattggtcacaggcgcagctcaactgtgaggaaacaggtaagggcccaagcggggccaggctggtctggcctgaaaatatagtccatcccacaggcatttattgagcgccactgtgtgcaggacagacacctctgacttcatgcctgcatttggaatgtatcatttagtcatagtatgtttaatatggtggcaatgtcattgatttaactagttggagtggccatagtctttttgacttgtccctctcctttctagtcatttatcctcttgcatactaggggtttggtttcattggtgcagattgttccagaactgcccatggcatccttttccaagaccacaaaagaggcttgacacttcctacatttgtgctaacatatcagtaactcacagcacctaattagctagaccagacaatctcgctttaagttggcagattttgtttgattgtttccggtggcgtagtcattctagatggattcctaagacatgctaacaatgagaagattaagtctggtctaggaacgataggcaagggccgttcaactctgcaatttggtgcatgatcttcagtgttgtgttaaaatctgccactgggcagccagctctcattacccatattaggagggctcttagagagcagtggcatggataatccacatcaatggataatctaaacagcacttgtgcttgtttaaaaaaaattaattgaagtattttttgcagtagcaaaattgacttcctaattatactttatggcaaatactgaaatgattttatgtcccctaagctcataccagctatgcagtagacagcagggagggcgggtggagagagctcagaaatgtctttgtgtctgctcaggggaaagctaatccaggctttaaaaaatcattttgggtaattctcagtggctctagccacagggagataatcgaataaagagggcgcatggtttttatggtgtcggcagcaccggcatttcttcagctcatctgactgctctgacagggtggaccattaagctggggaacttggatgatacaggcctcgcttgtctcagctttgctgtcactattttccccttctctactttgaatctcgtcttaatgagtatgccatcagatgcaattacacattttttaaattataaaaatttaattgcaagtctcctccctctttttcctctatttctttcttcctcctctttcttccataatttcatttaaaactagagaggaatggagtgactcctagagataatttagtgcatttaaaattaataggtgcatatcttgcagagggagcaagccattttccctttaacactaagaaaagaaatgagcttgaagtttgttcttttcagttccttggctgaaaccaggcatcttgcttatagctggagcatgtttgcaaggggtttgcagctccactgtggctgcaggagtgccagagacatcagtttggcaggtgatatgtgcccttggttgggctcactgttggaggggaacagcacccatctggtttgcatcctgctgcacataagcagttgcaggcaaagtgtgtttgcctggtgctagatttgcgtaggagttacaagatataccaaaatccccaatccaataaagaccttgttttcattctgctgccccagtttctctctagcagttcatatctactagtggatcagcaagaagttttcctaagatggtcaggaagataaaatagatagtaagttacttggaaggtgagtaatcttatataagtaacaaggaaataattgtttgtttatggcaaatcaggcaaacaagaggaagaagctagtagtttttgtttttgagggtctttaatgggttccggtcatttttgaccctgtcaaagactaggtttaaaccatcccagaccttttttaaaaaggagacagtctcactgctgcttccagaccttccctgctccctgtaacctcagcattatttctctcctggccatgacttcatatcttctttgttggcctttctccattcctctaaattgaagcatttctccagggctctgtcctctcacgatgtctctctatattctttcctttgtcactcttgttcccttagatgaatctttctcttcttccctaagcattcttttgttctataatgctgtccttttgagtccaatgagtaattcctcagtgatcgactagacattcatacttgaaagttgtgatagcaccttctaccttcagcatcagtctcaccgtcccccatcacattttgatttgcgtagcccctcccttcacttctctgtttgtgttcggggggactccattcttcacagtctctgaggccccaaatcttacctttgatgcttttttcatcattactcacatataatctgttgtcaagatttgtattttctcccttggtaaaaatgaaaattaacaaatgtagtacaaataagtacctaacaaaaactctaaccctcttactcatgtgaaattatgccagataatgcatattcacagattttctggccacctttctgattttttttttttcttttttgagacagggtctggctgtgccaggctggagtgcagtggcacaatcttggctccctgtaacctccacctcctaggctcaagcagtgcacccaccatagcctcctgagtagctgggactacaggtgcacaccaccacgcctggctaatttatgtatttttttttttttttttttttttatagagactgagtttcaccatgttgcgcaggctggtctcgaattcctgagctcaagtgatccacctgcctcggcctcccaaagtgctgggattataggcgtgagccaccacgcccggccctttctgattgttttctcctgcaaattactggaccactgctttactatgttttccaacttaggccctacctttctccctctacttttggtttaaagttcccttaatctgattggatgagaatttggcctgattccttaaaggccccttctaaccctaagatttcattaccaaaaaataaaaaagtgtatgaaggaattaagctgacaaggatttctaacattggaggagggaagaagacagagagaaaggaagagacgaatagtacataaaaatgtagacactgctcagtcagtgctcacgcctttagtcccagcactttgggaggcccagatgggcggatcacctgaggtcaggagttcgagaccagcctggccaacatggtaaaaccccgtctctaccaaaaacagaaaaattagccagccatggtagtgggcacctgtaatcccagctactcatgagtctgaggcaggagaatcacttgaacctgggaagcggaggttccagtgagccgagatcatgccattgtactccagcctgggtgacaagagagagactctgtcccaaaataaattaagataaaataaaataaactcagttaactctatgcaagggcagtggtgaagtgcaggtcttcgtggcaccacaggagtgcacagacacatcccagggaaattaatttactcattgctcagaaacattataaggagagaggaggatggcaggagcgttcaaagcctttgtgactttgtccattttgtgctcctactggactcttagactccactggagcagtggggactagaaaaatgcctgtgcagtaggacaggtcatctttagcccacccttacctgccacaggttatccattgggggctgcatgtgagtgctgctggtaaccacggacatgcaggttaatatttttcttgccctgtttcctgccaaccctttgtacttgcctttaactaccactgatattccatttcctgcaggccaaattttgtactcacacaatttgttgaagccagtagcctgtaagctttccagctttcctctctctaggtcataatatataaacctaggaccaacaaaactatgcaaacgctcatatcactaacttcattatcactgctgctactattttttaataatttatattaatacacaataattgtacacacttatggggtacatgtaatattttgatacatgcatacaatttgtaataaccaaatcaggttaattagggtatctgtcatctcacatatgtatcattttttggtgtgtatgtattgggaacattccaaatcttctatctgttttgaaatatccaataaattattattaactattattatcctactgtgctatcaaacattagaacttatttcttctatctaactgtatttttatacccattaactaacctcactttttttttgttttgttttgttttgttttttgagacagggtctcgttctgttgcgcaggctggactgcagtggtgtgatctcagctcactgcaacctctgcctcctcaattcaagcagttctcatgcctcgacctcccaagtagctgggattacaggcgcgcaccacaacgcctggcttatttttgtatttttagtagagacagagtttcgccatgttggccaggctggtctcgaactcctgacctcaggtgatctgcctgcctcagcctcccaaagtgctgggattacaggcgtgagccactgcaccctgcccaacctcacttctttttttttttttttttgagatggagtttcactcttgtcgcccaggctggggtgcaatggtgcaatcttgcctcactgcaacctccacctcctggattgaagcaattctcctgcctcagcctcccgagtagctgggattacaggcatctgctgccatgcccagctaatttttgtatttttagtagagacaaagttttaccatgttggccaggctagtcttgaactcctgacctcaggtgagccacctcacctggcccaacctcacttcttgacccctcactccccgctacccttcccagtctccagaaaccgtcattctactctctgccttcatgcaatcaaattttttagcttatagatacaagtgagaatatgcagtatttatctttctgtgcctggctaattttacttaacacagtgtcctccagttccatctatattgctgcaagtgacagaattttattcttttttatggctgaataatatttcattgtgtatatataccacattttacccattcatctattgatggacacttaggttgcttccatatctcagctattgtgaataatgcagcaataaacctgagagtgcagttacactgatacttcaatatactgatttcttttcttttggatctatagccagcagtgggcctgctggatcatatggtagatctacttttagtttcttgaggagcttccatactgtttttttgcggtagctgttctaatttatattcctgccagcagtgtacaagcattcccctttctctgcatccttgccagcatttgttattttttggctttttgataattgccattttaattgtggtgagattatttaaaaatttgcatttcttatgattagtgacattgagcattttttcacatacctgttggccatttgtatgtcttcttttgagaatgcctattcaaatcatttgcccattttttaatcagatagtttggttttttgctattgagttgtttgagttccttatatattctagttattaatcccttatcaggtggatagtttgcagatatcttctcccattctttaggttgtctcttcactctgttgatcgtttcctttgctctgcaaaagctttgtagcttgagataatcccatttgtctgtttttgcttttgttgcctatgcttttgaggtcttactcaaaaaatctttgcccagaccagtacccttgaagcattgccccaatggttttttttttagtcatttcatagttcaggtcttacattgaagtctttaatccattttgatttgtttttctatatggtgagagataggatctagtttcattcttctgctgctattatttgtaaatgagaaatgtaataacagaagtctgtaaacataaaaagactccccccagattgagcttttctggcattttcatagtggaacccagtttcttccttagaatagggaagagaagacaaagattcttcccctgagatcaccctagcctaaccagccagtcagtgatgccgacaagaggacagacactggctgctgtagctggaaagctggaggaagcagatgggtttgggggtcatgaagatgagcatttgggtcgctgcgaccgtcctgacaccagctccaacttggcacatacagtactccctttggcatcatccctggttcccagaaagcttgagaggtagaggctaagccagcttttctctcagcctgacttttttgtgagacccagctgcttgcctaatagtggccaaaccctatggctacagtggcaaattcagagccaggggagggatccacgcagacctgtcaaacgggcagaagctacacagacccatcgcacttgacagtctggtctctgtcctgaacatctaaagccctttctagttaagttcggtcccctctccctgatctctttcttccacacagctgaattattgtacattcagctgcattataaaaccctactggtttaggccaggcacgatggttcatacctgtaatcccagtgctttgggaggctaaggcaggaggattacttgaggctaggagtttgagaccagcctgggcaacatagcaagaccctctatgtaaaataaaaacgtgctgggtgtggtctgggtacctgtagttccagctactcaggaggctgaggcaggaggatcacttgagactatttgctcaaggttacattgagctatgatcgcaccactgcactccagcctaggctacagagggaaaccctgtctctaaaaacaataaattaatttaaaatataaaataggccgggcgtggtgactcacgcctgtaatcgcagcactttgggaggccgagacaggcggatcacgaggtcaggagatcgagaccgtcctggctaacacaatgaaaccctgtctctactaaaaatacaaaaaaattagctgggcatagtggcaggtgcctgtattcccagctactcgggaagctgaggcaggagaaaggcatgaacctgggaggcagagcttgcagtgacctgagatcgcaccactgcactctgtctggcctgggcgactgattgagactctgtctcaaaaaaaaaaaaaaaaaagaaaaagaaattgtatatataaaataaaaccctactagttttgagtaatacttggtatgcacacctggcaatgtttgctgaatgcctagggtgcagtatgggtagtggcaaagtgttaggtctccgagggagattgcctgggtttgaatcctggttttgccacttgccagctgtgtgaccatagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgccaggctatttttagtagagacagagtctgttgcccaggctggtctcacactcttgatctcaagtgatctgctggcctcggcctctcaaagtgctgggattacaggtgtgagcgaccgcacctggcctcactttttcattttaatgagtataataataataatatgtactccataggattgttaccagcactagtccatctaaaggacttagtacatggcctcacacctctttaaattcctctataaatggtaggcactaatgttcatgtgttaataggaaatattactctccttgcctccagtcccctccccagtctgtagaaggcaaattgaggcccaaaaaagttcagtgacatgagccagactgtgaagcaaaacaacagagcaaagattgacatctgggaggcctgcttctttgcttagtacctgttagtccccactatttagagttagtttttcttttctatcttacctttataccaaacaaaccctctttctgaagctcccattggttcattctgctaccttcaactgagaataattgagcacctcttatgtgagagcatcatggccaaccctggacacccaggaattgacataggatctgctcttgtgaagtttgagctgtagtggtgacaagtgccaacaaatattcacatccacacattggagtcacagtcagggttgaggagaacatacccccagcaggagcagctcatgcaaagccacgaggcaaaggaggactttgcagaacagaaacgtggccagcatagctgtagcagaagctaggggaaagaacaggcagtggaactggaggcacaggcagtattcctggcatgcaaggccgtgtaagagagtaatgagaggtctttgaaagagtttaaataatgaaatgtgcccttttaagattacctaattactatgtgaaggaagagaaatgcgggtcagaagatggcaaggatgggaattgaggtattggtggattgaactaggttgggggcagttgagatagagagaagcgaatggatttgagagatatttagaaggcagacatgacagaatattaattaattaggtggtggagaaggtggtgagaaactggtttggggcagaagatgatcagttttgtttaggacatgctaactttaaggcatctgtgtagcattccatgtgggtggttgtatttttgtgctctggaacttggaggacaggccaggtgcttctttgtagaccggctggtgatccgctaagacagttctgcacggtttggcccgttttctctgaccctgggctatccctgtttgaatattctaatgttgtgtttccctttggcttttcaggactccagccaggcaattcctctggtggtggaaagctgtatccggtttatcagcagacacggtaagcaggatgacagccttgtccatatttgtgcaaagattgggaagaacttccaggaattctttgtagagtaagaatagagattgacttcccatcctggcattctcagaaaaggaataaattcttacttgtccacataacttttgctacctcaaaatagccacacctagacattgaaagaaatgcatcatatattttgacacaaaatgcctcagccacttatcacgcagcatttttttagcttgagagtaagtttgaaattgcagctgttatgtaaatacagctgctattatgtggtaacagtagtttcaccattactcacagtctttgcaagtgtgggtatctcccactgtacagcctgaccattttgtcactttctgtaccagactagtttgaaaacaactcctttcccaatgttgcagtgattcctaataatcagtttttgttctggtttggtctcactggatacagcatggccaagggctgagttagtagctggtcttaaagttgtatccaacttttgagaatctgcagaggcaggctgcttctcagcctaggtgaaatcatactctcttctacttggatgaagctgaatcttataaacaccattcctcaccagctactggtctcattggacagaatttagcgatcgaaataattgccagagaattgatttcccagggattagagtgtttataaaggacagaactagtgctatgaaaatttctaggaactgagcatcagaaattgtttttagatgctgttctttctgtgataggaaaaggggcagagtgacctttctggagctaaggaggtagataaaatattgcttgtctaaattcagaggcagctattctctctccctctccttgtctttttctctccctgtaaactgggacattgctcaggttcatttttggaatagtaattattatagcatggttacaattgatctcattctaatcagctataatttttaaattttatccctattcatttaaagtaacagcattgtatatcagtattgaacagtcaacaaatttatcaagtccctgatcaatgctgggtaccatgcattgccatgcaggaaaacagaaacaggaataatatactcttcctgtctttaagtggttttgtgatgcagttgggagaaataagtaagcaagtgataagttaaataaaaagggataagctgtggtaattcagaatagagtataagaaatttcacaagatagtaatgattaacagtcaaacagtttgcaaagaaaagtccaaacggagttcaggggaggatgaattatttgtgcctaagagacaataggaagaagaaagtctgagccactgttcattagcatacatttcattcattgaacgaatacatattagttgcttattatatcccaacaaaaagtttctgccttcataaaccttacattccactgaaaggtggataagcaaatgaccaattgatcagccagtaaatacagtatgtcaggtattggtgaatgtcatgaagaaaagtaaagcagggtgaggggatggagaaggaagagggaacactgtttgaagctggttcagggaaaaggcctctcctaaagtgacattagggcagagttgtgagggagtaagccttgtggatatctggggaagagtatcttggggagcgggaacaagtgcagagatccttgccatatgcaggaagccagcgtagctggagcagagcaaatgaaaaaggaagcggcaggagatgaagctggaagccagactcttagggcctcatgtgctaggattggattttattctgaggaagatgggaagccactggagaattttgaacagggagtcatctttttaaaggatccctgatgctctatggagctaagactgtaagaaggagacaggaagcaactgcagtagcctgaggaagacatgatggcggcctagaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatccagcagatcctaggaattctagaaatttgccatgaagttacatctccaacaatacaaaaatgcatgcgcacaaggttatttgtgacagcattgtttgtagttgcaaagtattagaaacaacctaaatgcccatacatagaggagtggttgaagaaactatgggacattcattcaatggagtactatataagaatgagtaagatttccttgaactaatatggagagattcccaggatatgttgttaagtgaaaaaaacaaaatgtgaaagagtctatatcatgtagaatactacagatgctcctcggcctctaatggggttacgtacggataaatccatagtaagttgaaaatgtactcaatatacctagcctagggaacatcagagcttagcctagcctgccttaaatgtgctcagaacatgtacattggcctacagttgtgcaaaatcatctggcaacactatacactgtagagtatgtgttgtttaccctggtaatcacgtggctgactgggagctgtggctctttgttgccgccaagcattataagagaatatcgtactatattttgctagcacaagaaaagatcaacattggaagtatttctcctgaatgcatatcattttggtaccatcataaagtcaaaaaatcataagtcaaactattgcaagtcagggactatatatatagatattcttttgcatttcattaccttttatataagagagaagaagatataagaatatccacgtatcttctcatttctgcaaaaagaaatgcaggaaggatgaatctaggaactaatatttaattggttacttataggggatggatggaaaaaacgtgaaaagaatggggcaatgggaaatggtaaggagtggcatttctcttaccttagtgtagttttgacttttagaacaacattagtgtttcctgtactcaaaagataaataaacaagccaagcatggtggctcatgcctgtaatccaagcactttgggaggctgaggtgggcagatcacttgaggccaggagttcaagaccagcctggccaacatggcgaaaccctgtctctactaaaaatacaaaaaaattagctgggtgtggtgttgggcacctgtaatcccatctactcgggaggctgaggcacaagaatcactcaaacccaggagatggaggttgtgatgagaccacaccactgcactccagcctgagtgatagggtgagaccctgtctcaaaaaaaaaaaaaagataaataaataaataaaggcagagtatgggtacaacccaaaatggaatgcagacagtaacatataaacctaactgtattacaagtgaataacgtaaccacaatgaagagaatgaggaagaaaataacctaagtaatttgtcttgactgtaatataaatctgaagataaaaagatctctaaacaaatattttacagtaattagtaattttttatcacacaaatatggattagcaattctaaaagtattttatatatattctaggatcaagcaaatatattgtggattttttaacaattgagcacatagtagctgctcaaaaaacatctgttccactaaattgatttttcccaaataggggcttaaggtgctcatgaactccctaaaaaaccatagtaaaaatttttgtgtataggcatctaatgaggatagagctcataacctgtgtcagtcttgaaagagtctgtggcccactgaatgctggggattttcacatcctaactatcctcaaatcccatgggaggtagacattatagtccccattatatagatgagaaagctcagtggtgggtgagggtgattcaggaaggcttaaaggaagagaagcgatttgaggaacaattgaaactgaatcatgatggaaaaaaacaaaaaaacaaaccgccattttcatgaggaagggagcaagataacgtgaacatgagatggctgctgtagaaatcatttgaagaattctccaggagaacaacttttggcaatggttggatcccgtgcacaatggaaggttttgtgccatttccaaatagcttagtccaagtctgatgagttttatactttcatgttcatgtgaactgagaaaaaatttaaaagatcatggatgtgtcactttggttatgtaaggattcgcctgcattataataaaaagccaactggtttttccctttactttctggaaaccagccacttattaatgtttctgcttctagaatctagagattctgtctgttgagcaagaacacatagtagtccctccaaaacataagttctcaggaggaaacagagaccagacctaaagagagctccatgtgttccaggcctgctgcctgatttccaatgagctctcctctcatttcttcttgtcctggacccccaggccaaggctgcttttccttggtgtcctaacctaccaaaaagtatcaagatgatgacgctctttcaagaatttgtgcaatggcttcaccaactagaacatagtgagtagcctggtttccgagatgacatttgcttataccatgttgtgacatgtggctgtttctctcaaagcacttgttgtttacatactatctttaaacaacattatctggcttttacatcccatttgtaactagtattatagtcctattacactggtactaatgaggttttaacattgcctgccactctgtgaggaatattctggagattcctttataggagcagacaacttaaggcctattacaagccaggtaactatatttcctctgcttactttttaatgttgtttcagttggattcaaaatatcagtcccggcctatgtggtttacctccaaaggtctaactgatagaattcatctgcctcctcactgagaaaccctcaaacagtgggcaaaatgtagcattagtccattttgttttcctaaaataaaatttgagatttctccagcatgtcaaggtttttgaaggattgtgccgtaacagagggattttgacagaatgcttaagattgagacccagggatcctgagaaaagctgagcggtcctgatgcaatcagagatgctagtccagtccaacccctggggctggcactgatgacacacttgctggatttctcacccgttttgcagttgtgtgtgtggtgctgtctgtaaagccatgtccatgctcagactgaccaatgtggttccagcctctgcacttgcactccagtagactccagaagcctggtgttgaggactgagtatgattgcagccacaaggcctgagtttgagtcatggccctggttcttacttcctgtataacttaaggctgactatcactcatcaatcccctcatccagagaatgagattgttgccaacctttaccttgttgtgacattattatttctgaggaccaagtaatttatttctgtgaaagcattgattagcagcagtcactatgccagcatttttttcatgatttttttctctaacaaaaccaagaaattcttgtgcacattatcgtagtataacattcatgcatgtttgtctttagagtaaagctgtagtcaggaaccagtgcctagcacaatgtctggcaatactatctgttgactgatcacttcatagcaagcttgttcaacctgtggcccatgggctgcagcacaaattcgtaaactttcttacaatattacgagattttggggggattttttttttatcatcagctatcattagaatattttatgtgtggcccaagacaatttttcttccaatgtggtccagggaagccaaaagattggatgctcctgacttatagtttcatgttctctctttttcatgagtattgaaagcattgcccccttgaacaatcaaaccgtgttaaaacagctaaagcaatattataatctcagaccttatgaaactcctctgatgagaactaatgccttgacctatttcccattcttttttttttttttctttgagatagagtccactctgtcacccaggctggagggcagtggtgtgatcatagctcattgtagcttctaacttccaggttcaagtgaacctcctacctgagcctcctgagtagctgggactacaggcatgctataagcactgtgcctggctactttaaaacattttttagagacagggtctcatgttgcccaggctggtcacaaactcctggcctcaagcagtcctgctgcctcagcttcctgagtacatttttctattcttgaccctagatgatttaaaaaagtaccaatgggtcacttctttgctttacagatgggaaaagagaggcaaaacaagggaaggaatctgcctcatagtcgcccttggagtcaaaggagtctctaacttggtgctttctagtgaaaatgaatgcctcgaaattattccagtgacttttccaacatccttgcacatgtttttctcctttggcctaaagaagagagacagcgtgcttaaatacatgctggctgggggagacagatattcaactaagcttggcactatgcttgtgaatttgctttttcttcttcttgatcacttttctgtgtatttccaggactacagcatgaaggaattttccgggtgtcaggatcccaggtggaagtgaatgacatcaaaaatgcctttgagagaggtaaggaaacagtcttgaagataaaaccaaatatttgccagccccctggggtattggctccaccctttcttctctaagaggtccccagaggtcaggaagccaacttccctgtctcttcagggggtacctgctgtcttgtacacattcccctgtagatatgcagagaaataccagggcacatcccagtttccttcttctttcgtagccctacccatcctgcctctttcacgccgatgatctgccaaaacccaagaagttaactatgatatctgggcggtttatggcttcatccggaacccttggtagcagttaatatcaaggctaatgcgcttgttcattgtagcccatttattattttgtgggctattaaggtaatgggcaagctttggcaatttccgtcactgtaatggatatatatagtgtcaatttgaggttggccctatcattaaatctaattacatctgatatgaaattttccatagggagctctggcatgattgttctgtaagtaggtgttcttggttgcaggccaggagacgtgagagccagtctcaggagctggcctccttggcctcatttttctccccgcaggggctcagtcccagcctggtttcatgattcttgtgagatacagttgctgtgtcccatcctcagcccatagggaatgtccctgagccaggctggcacaagagagtttatattggtggactcatctgccgtgctttggtcctggagcccctgaaatggagcagtctttgctttatctgttccctggtctgtcccactcatggccaccatgccgggcagaaagctgatggattgggaccaggacatgcatggttcaccccttccccacgttcgtcctgtgtgtttttgcctctctcactctctttccttttcgtgggggttgcttatcctcaggagaggaccccctggctggggaccagaacgaccatgacatggattccatagctggtgtcctgaagctttacttccgggggctggaacaccctctcttccccaaggacatctttcatgacctgatggcctgcgtcagtaagtaccattctggcttcagattggcttctgggctacagcaccggtagcaagagagaaaaagtttccacagggtctgtgtgttctcataagcttttcaatgaagtttttcttttccccagtgaaatttctcctcagcctcactccttcatcccctggtgggaggggaggaggaaagacttttcagtaagaatctaggaccccccaagtcagtactcctggcctttttttttttcttctgattcatctctgggctttatctttttttagtaaaatacctttattttcaattatgtatttgaagcttatacattagtgcttgtgcttttcatggtacaagggggaaaagcataagcgttgcaaatatttcatgcttgttgcattaaacaagacatggcttacctgctaaatgtattaatatgtgttctaggaacaaaagccctctgcacatttaaaagtagtaataggatattttcccaaagagaaaggtatattctctgctttatcctcttaggagttctctgcctcttactctaaaatttgggtcttgaaaagctattcctagccatttggtttagcttgtggtactggaacaccctctcatttgtttgccagggaaaacaatcaatggaaacttggattaatacaggtcagcctggaagcaggccctgtctgactgatggctccagaggctggagggagtggtacctttgaatggagaaaagatccttcttcctaggttgaccagatcttcatacctgctgagtttccagtttcactcagtatctgccctgagtacttgtccctctctgttatcctgagaaatgcccagggcatttgggaagctggctctctggtttgttttgttgacttctgtttgtgggagtctagtggaagtgagttatgtgggtgattaagaatgtgattcccttgggtcatgtctttgtctttttccgggactgggcctaggtgaagtatcttaagctgaactggggttgccaagacagttcaatatcccttggctgcccagttcttccctagagatacactcttcttcctaatccagtacttcccatctctttttcatataaaggcactcatagaaaatggcagtgtttacatggcacactgtggaagtgagaggctgcctatgatggaggacctgtaattgacctataattaacctctccacagcacaagaaaacctttcaggtctccttcccaatatcactacatacccaggggcctgctacctcttgcctcaggccactttttactcattcatagtgcagataagggagggagaagataagccacacttgtccagaggatgagatggcatgtgtggagtgagcaggacaggcctcttgcacagcctctcttcccaccgagaagtaggccctttgaggctttgtgttgagcagttacagcaggttggcggcagctccctgtcagtggttgtttgaataagagggtggtagatcctgtggggaacatttctaaccccatttcctgtgcccaaatccaaatccaaacttgttattaataacaatgagattacaacaaccctagttcagtttaatattaataatgtgtaataacgagtttggatttggatttggcacagttccctgtgcccaagaagtatacaccttacatccggcaatggtaaatgtctggagcccagcaggtgccctcttctaacagccctactccaaggagcaacagggatgacactcctgtcactgcaccagtgctgtgcgtgggcttgatctgatgctgtccgtgttgcccctgctggtagtagggacttctgatcattactgcctgggatcccagtcatagtggaggataacacatggctttcttcttttcagcaatggacaacctgcaggagagagctctgcacatccggaaagtcctcctagtcctgcccaaaaccactctgattatcatgagatacctctttgccttcctcaatcagtgagtagccttcccagtgaacagctggatcaggctttggcttgggcactggaagttcctctatggacctatgcctattcatccatcccaacaaaatatttattgagcacctactgtgtgctagccacagtgctagacttatttaatacatcgttaaataaaagatgaaagccttgatataatttagctcctgttccagggaaggaaacagccaataacagatatatcaggtagaataagtgcttagaagaaaaataaaaaagagtaaagagaggggaaagagtaaaggggtctgaatgaaaggagggagaagcactgtagttgaggtggacagcagaggcctgcctgagaagacagtgtacaagcagcagcccagaggaggagaaaagagtgccacggggccatttaaaaccccagagtcatggtaatagcgagtttggatttggatttgggaagcaattagaagattttctttttttttttttgagacggagtcttgctctgtctccaggctggagtacagtggagcgatcttggcttactgcaacctctgcctcctaggttcaagcgattctcctgcctcagcctcctgagtagctgggacccaggcgcatgccaccacgcccagctaatttttgtatttttagtagacatggggtttcaccacgttggccaagatggtcaccatctcttgacctcgtgatgtgcccacctcagcctcccaaagtgctgggattacaggcgtgagccaccgcacccggcatgttactatctgatttgtgtattttatttttttaaaaactgccaactgctttgtggagaagttactggaaagggtcatgaagagaaacagggagaccctatcccaaggttaccatctggtctggccagaggtgttagtggctgagtctggagagcggtgaggaggggtcaggtttgtgatacattttgaacatagcattaacaggatttgcccatggattatacatagaatatggagagagaaatcttaaattgttggcatgagcgacagggacatagggtggtcatttatggagttggagaagacaaggtgtggagaaaggaatcaagacaatgtgttgatgtggtcatggtcatttgaggcacttgtgagatgtccaagtggagattttgaacaattggacctaggaatccaacccttaagggagaaaccaggagtggagctgccagtgcaggagttgcccatgtactggtggtatttagctaatcacccagggaacggatgtgtctacaacaaaggtctgaggagcagagggggccgcgggtgtggatggggcatttcttctcgtccaagcagcatgtccttgtgtggagcaagctttggagtccccacatgacaggaaaggcaccaagcaaggacatgtgattcttcccctctgaggcacctctgtcttttcactttggttttgctgcagtttcgccctcaacagcctagaccaaaggttataaatgggcaccctgagagccagataaagccgaagatgtgttctcttcaggtgtctattgtgtcttgagaacaatgaaatcatacttacatttggggaaatttcactttttaaaaacctagatttctagcttcttttgaaaaattattagatctggtgatactgactctgcagtccctggtggcagcaattccctgtggagtaagggctgtactccctagatggggcaggcactccccaattcaccacagtccccagccctccccgttgtcccccaatcctgaggctgaattcagttgctatttatcatcactcttgttttgtggttttcatagagaacaaaaatgtttctctggatccatgaatctatcagagtaggggaaacaaaaggtaaaccaagggacccaggtgtttttgcacatatttctttgtgaaaatgaggagccttctacaaggttagtctctgcttaaaaggaatacaactttagagaccatttcataagtgtcagcttgcttccaagtttgtggtcaacctggccttataggtatctgggttagtggccccagcttgagaccttttctggggcacccacactatcatgtagcccccttgctggcccttcagagctacagagggtccttgttccccatcttgtctcttccatgcggttgtgtctgctctattcattggccaggccctgactcagcaccaccactgcctttgggttgaacaccccagtgagtcacacagcgtgttcatgtgcagcctggaaactctgctaattactctcgagttagtcccttcagggctaccagtcattgtctcccctcagagaccaatacctgccctcaacatgagcctcgtctgtgcccccagagctgggagcatgacagtggtgagcaaatggggatgaggggaaaacagggagggctgggggactatatgtgacagtacagtggggagaaacaatagaataagcatccatgcagggttgctgcttgcagagatggcagccactattgaagacagcataggaattgcaccaattcaaattattcattttgttttgcttttattgggtttttttctgattgaaacgagattgatttgctcatcaaagtgttaacattaaaaaaatgcagcattaataaagtgttttctaaaataataaatagaatgcaggacacaaatgataaagcagaccacctccacaggaagacagcagctgacaggtgtgcacttccggacaggggtagcaatagttggcaggtagctcccgatgcagactctgcctgggcccagaccatcaggaccctttttcttcattgctgtgagtcctggatgtatgtgtactttatttctggctactgtttgttcttggattggacacattgtcaatctcaaggaaccaaaaaagctaatatctcagtttctgtgggtctggaatccaagtacagcttagcaggggccctctggagaggtaattgcatatcattaaaaagttaaaaatccagaaaagtgcatgctaaaaagtaagtttcccaacaccaatcctggcgccccaaaaagcctctgttcctaaccacaatgctgaacctttttatgaagcacaaaagatgagttcaaatcagttaggagaattcactaataatatgaactgaaactgtagaaatacagtagaactctttgaggacatggcatgagtgactacaagtcgacaccaaaaattttaaagcagagagttgttactaatgttatccattttaggtatttctttgtttttattttgttgttgtttgtttgtttttgtttgtttgtttttgagatggagttttgctcttgtcccccaagctggagtgcaatggcacaatctctgcttacggcaacctctgcctcccaggttcaagcgattctcctgcctcagtctcccgagtagctgggattacaggtgcatacctccacgccagactaatttttttgtatttgtagtagagacagggtttcaccatgttggccaagctggtctcaaactcctgacctcaggtgatccacccacctcgacctcacaaagtgctgggattacaggcatgagcctgtaattacaccgcgcctggcctagatatttctttaaaaataaaaatccagttttttatactcttacactagacacagccttcagggacttcaaagattattaacaccatgacattttacacaaaactgtgtgcatttatatgcgcacatatgtgaatttttctggggagagaatccctagtttttgtcaagttattgaaggaacttgtgtcccctaaatagttaagaaccactgctttaggacaggcgcagtagctcacacctgtaatcccagcacgttgggtggccaaggcgggtggatcacctgaggtcaggagtttgagaccagcctggccaacatggcgaaaccctctctctactaaaaatataaaaattagccaggcgtggtggtgcacgcctgtggtcccagctacttgggaggctgaggcaggagaatcacttgaacccaggaggcagaggcctcagtgagccaagattgtaccactgtaacccagacaggcgactccgtctcaaaaaaaaaaaaaagaaccactgcttcagcccctaaacttagatgttcccactgtatattggaaaagaaaaatggattttcatctgtattttgatgggagcaagaaaatagacctagaatcatgagaccacagtccacaaagatgtgtcctcttcaagctcctggtcattgtagccacctatgaattgaacagttcttaccttagcaggcttcccaacattcttcatcttccacagagctttgactcaggactctcaggactagagtttgtttccctttgaccatcaggcttcccagacactactggttttcttttatgttaccaaaacattgtcagatcactctaaagtatcaaggccttcctcctctttgtccctccatgacaccaggaactggccagccttggattagctacagcttaagcctgcagcacctcatgcctcagttgtttgctctgaggttaccaaggtaattatcctcctgtccctccccagttttaatttgactaggaagtagacttagaaacttcccctagtcttttctaaatctctgctctctttgaactcaggatccggggaaggattatacacttttaagaactcctgtgaagcaatccaatgagatttgtaacctcccccgttgctggcctctcctgcatttgattccaggctctagagaacagtgattctcaactcttttctcccatcacgtccataataccactcttcaagtcctgcagtgattcgcaaacagacagggggtacatctccaggaggggagagaaccactgagtcagagggtaatgggctttgtaatgtgaggctggatgaggggtacactacagaaacaaactctgcaatcagttctgaagaacagctactcagatggagacagctgagtctcaggcctcgtttcccaacagaggacctttggttccttctcagaatcaaatcctgcccatgcctataagggagactcctcagcagagctcacagctctgcaggctgtgttggggaggtatccagagctggcccagccctcaatgcctggacgggcaaggcccaatgggactcatcaggtgcagtggctcattgaaggccttgggtccttggccaaggttggaggtgtggctggaacagctgctggctgagaaggggagagttcccagaataaataaatacccgagaatgaagtcagcctgcatccagaggaagcccgagcagaagccaaatggcatgctgaccttttcctgaaaaaatcctgaatgtaataatatagaaggagattatgaacacgaaaaacaattgcatttgctgttctaggaagaaattcactggcttgatggaatacaaaagctaatcagttggctatttgttaataagtctagaggctagaaaggaatatccctaataatttgattattttgttatgcaagaaggtacacaatgcacagtgcctgtgcctctgaccatatctttaccagggcagcctgagggtccccgtctgccctggcagcttagtatgttggtgtgtagcagccatattcagctctgcagagtgacatgttctcaaggtcatgtggcctttgatagataagatccggggatagggatgaggatggggtggtaagtagaatttgaaatgggagctggaaagagagaagggatcagagctgcaagcaagtacctctagtttgcatttcctgagctcctgaatgaccattctggttgtcagttttctccccagcttactttctggaaagtctctgacacccagaaaggcaggtggcaatttgtggaccttctgcttttgctcttggcagcgcctcctgtgattgtgttttctgggcattcatgcgagagctttccagcttgccccctttcccttctcctccagtttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactggtaggggggcttgggacgggaggaggggagggattcactagcacacactggcatgggagccagatggccacacgaaaaccaaagggaaacacccagatcctcccaactcctcactcccaggctgctagggtctggggatgctataggcagcccccacctcggccccacccacagactaaatgccacttcttgccacctccctttttgatgagttctgagtggcaagggactattctgaaagatattgacaacattaattgtgatactaatctctaagaaaggactttttataaagttgcatctagaagtgatctttattcatcaacagtgtctcttgggcttctactctgtgctctgtattctgagaaaaaccatcctgggtcccagggaattcccttccttttgggaagagtttagataaaaggcataatttcctgaccgtgagtttgtaagctggcacttcagaatgattttagaaatttgtgaagagaaagaagggtaagccttgtttttggcaggttagggacagtcctcccctgaagcagcattccattctgtggggccaggttttccatgacctagcttcggaacagagatctaaaaggaatccctgggatatatgtttgctagacccctctgtttgacaaagaacaaatcactatttctattttatggatgaagtagctgcaacccagaaaggccagtgacagtattttaggccactctagtgatgggaatttaaccccaatctcatctctttgtacagggtacagtccgttaccccatgccacccgccatggtaccatttacagcgtcgttttttcactaaacacaaagacaactgcctctctcttttaatccctaacgtcccttacctccccctcctcctccccctcccttcttcccctaaatagtatttcagcctgagctgaaagcacaagccagcccaaatcggattctgtctgaattcaacatctggaaccaattcggccagccccattgctatcgactgaggtaggggaggacaggggaggttgtttacttaattagaggccaattggtccacgcttctccctgacccccacagaacagcctcttgcccaaggagtgaagaaagtggcatttgtgttctgtgaacttagtaataccagtgacatccctgggttcatccctctctgctgtactgcagatttcagtgtctgggtccaagctggaggaacctatgctggccagctgggagagaaagctttttgtcaccgacagatggttggtggtgactggggaggttgttggtcactttaggtctcagcctactggatgatgagctccagggagctgtccttgtgcatgtgacttagagctttggttttcccccttgcatgagtggtgaaaagctgtagaatagcattcccttccttctaaagtcaggcagaacctccgccctcacttctcaaacatcaaaccactgcaggctctggtccagtgcccggggcacagagacccctacagccctggcccctgagtcccagcccagtgggtcagagtcctggaggggtgtggctcacggggacaggtgccttcctccagtttcctccaagatattctcccaacctaccccctgtttcttgtgcactcaacatttattagcagcctctggaaaaaccacaagattagtcagggaacattactaccgcagactgtgtgggaggctagaagcacctgaggaacaagagtcagcaaccttgggttgagagggaccttctaaccgctggattcacacccacctggaaggctcatggcctctcctctcccttctttgggaagtgagagaagtgccagccccgggagctaaggcagtaaggaggtgagtgagggtggtagaaggggagatagagcactaagaagagaatggagaatgatcaggagacccaaacagccatggaaaggagagcaccaggccacatggcctccccacagctgtggagaggagagacaaatccatttcaccacactttccagtcctgaaactggaaccggttttctaggactaccggctgggtggcatggtggactgctcctgagacctcaggtatttttgggtctggtgggtgcacaagagcaaaggctggggatggagtgtgtttcaagagaatcataggattttagggctagaagagacctcagaaagcatcctcttgcctttctcataaagcagtggttttcaaagtgaggtccctggaccaacagcatctgtgtcacaaaggactggttagaaatgcacgttatttggctccacccagacccagtgacacaggaactctgaagatggggcgctgttttttaacaagccttccatggctcgctgaagtttagaactgttgccttactggctggctgtgtaaataaacttgaagccctgagggaaagtttgcctttgaacctctcccccgccacccccaccatctcaaaggtttccagaacattacaaaattcatcagattcatcagatggtttttagccctagaaaacagtgagaaattgtgcctacattttttgacaaagaggaatctccgtttatattcttctagaatgttctctggagcctgggaaacctccttggaagtgacttgctctacacaggacgagttctgaactggtcacccagtctttgaggaacttcccaggagtgtaggatccatcccatggggaaagaggcttgagggttccaaggtggaaactgtgcggccaggctgccaggctgagtgggtgatggtgctttcacacaactgcctggaaagcctcacctgttactgcctactaccagaggaagaactttagaaatgaacagtttctctacttttcaggaagtaagaacttcctggtgcccatcctcatgagttctgaagtccatgagccaggagatcaggaatagaaatgactttcctagtaacctctctatcatttctcgattccttacactggatgatttttttttttttttttttttttttagacaggatcttgctctgtcacccaggccagagtgcagtggcacgatcatggctcactgcagcctcgacttcccaggcttaaccaatcctcccacctcagcctccagagtagctagaaccacagcatgcacactggcttttttttttttttctttttttgtagagacagggtctcattaagttgcccaggctggtcccaaactcctagactcaaatgatcctcccaaagtcctgggattacaggtgtgagccattgtgcctgacctaccctgaatgattttaaatttcatgaattatttcaagaacttgacccagcttctctcccctgccctccaacccataattggatcctgccctgtagcccatagcagattattcctcccctacttttgtttcccaccctctcctatgactcaccttccactttttcaccagttcacagtctgaactgcaaagcaacctagaggcatcaagcaaaatgagaaagaaggaaagcaagtactatttattaaacacccactctgtgccaaacttgtgactaaattactttattaaatcctcacacagctgaggatatagatctttatcttcagtatatagatgaggcagctgaggcttaaggagattaaataacttgcccaggatcacacagctaccaagtatcagagctggttttcgaatccagttttatctgatgccgaaacccagtgtttcccttccaccctgcttcccctttgaaaaccaggaatgaattcacatagagaatcagaccttgaggagttgagttgttctctattttctaaagaatttagtttataccttcaaaagggcttccctttgtcttgagatattctaagttccaagtagtctcaagtggtttttgtagcaggagctagactggaaaaactctagagctttgtatttcattataagcatttgtctattgtgtgcagttaggatatagagagcataagatggattcagtgccctcgcgccagggaggctgtatgaaggggaagacaagaattgtatgagcacatgttaatgtccctgtcactcttgcttctgttgcagtgatagccctcatggagagactacctcggttgaagactcaacccaggatgtgaccgcagagcaccacacgagcgatgacggtacgaggccctgcttcctggtcagtggggacgccaggggtgaggcagaaggaagcgattatatatcctgtgcatctgatgaacctgtctgcccagcggtcccctgagggcaggcagagagctccctgtctcaatttcatttccttccttccttggagaggtagcccaccttctcaaatagaatcgctcgtattaaaccagaggtgaggaactaggcctttcatagcccttcaaccttcttgctccacctcccagctccttgtctggcctgagtgcagcatgatgttggtcccttatcatagcctagactcctgccagacagctggagaacaaagtgaaggaaagtacatttgaaaaacagtaagcaattgggtgtggtggctcacacctgtaatcccagcactgggaggcccaggcgggaggatcacttgagttcaagaattcaagaccagcctaggcaacacagccagaccctgtctcttaaaaaaaaaaaaaatagcctggcatggtggtgtgcagcatccctgtagtgccagctacttgggaggctgaggtaggaagatcccttaagcccaggagttcaaggctgcaacaagctatgattgtactacagtactccagcctgggtgagagagtgagaccctgtctaaaaaaaaaaaaaaaaaaaaaaaaagtaagcctggggtgggaaatagcagagctggttgcccggaacccaatagaagcaagccagagggagtgggaatgaggatgcagaaaccacatgctttcacgcctaccgactggaaaaactgaccctttccaaagtacagacatgcgagtgccgagcagcctggtgggcgtgcatcaaggggaggaatgctcagctgtcatcctcaggcccctcagcagtgcccatgctttatgagggtctgtccagccagcacatttcccccgcttccaacagctccacacctcctctggatcacatgggctctggaagtctcagcagctgacaaggggcctcagaattttctgggcacaagaatgaaatggcaacagtctgtggagttttccctgttccctgccttgctgggaattctgcaattctaggccagctttcaaaggagaaaaaaaaaaaataggactgcttatttagatcctgatgtcataaggatccatatgatcatttgctacattcgaggaggggagtaggtgaactaggaaaatgagtagtgggttagagcctacctcgtggccagctctgctagagtctttatatatgttatctcttaatctgtagtgaaaaagatatggccgctattttacagttgagaaaatgcaggtcagggaggtcgagtaacgtacccgaggctgtagagaactaactgaggtgggtatatttagacaggccttctctgaccagcctcctatagtgaaatctccaacccctcctgtgcaggagcagacccaccagctagggccatctaggcatggtcttatttttaagcagcctttctctctgcttcccagaatagccgactttcatctcaggttccagctttctgggagccttctctttgctctttgatctctacctgcagcctagcacagacgaagataatgataacaataagtcgtgcacacataccacttactatgggcgggacactgttctaagcacttttacaaattgtaattcattgactcttcataacaacttcatgaaaaagacacgattattaatctccatgttacagatgaggagacagaagcccacacaaaaataaagatagattgcattcgtagaccccttttacttttttagattactttcatgtgcatttttttcataggttggtcacaaaatatattttcatattttgctccttggaaagttgattgggcaagttattttctctttatagagagacagaaagctcacattctacttactagggggaatggataacataaaatatttagaatacatgtatgtattctaaaaaatgtatgatacattttctacaattactggaattattatataattagaaaagaaataatgcttaaaaatatagtatggcaagtttgatgatagacgtcaaggcatgaagatctttggaaacaccaaagaagttactgtagaaagcaggggatgcggtcgggcgcgtggctcacgcctgtaatcccagcactttgggaggccgaggcaggcagatcacgaggtcaggagatcaagaccatcctggctaacatggtgaaaccccgtctattaataatacaaaaaattagctgggcgtggtggcacacgtctgtagtcccagctacttgggaggctgaggcaggagaatcgcgtaaacccgggaggcagaggttgcagtgagccaagatcgagccactgcactccagcctgagcgacagagtaagactccatcccaaaaaaaaaaaaaaaaaaaaaaaaaaagggatgcttgagttgtgttttgatgtgcttcatcaggcagataagagagaagaagattcctggtggagggaacagtgtgagcaaaggcaggtaaaaggtgataccagtgctttcaggataatggtatagtctgcgtgagaattacttgctttatagatcatccatggcttcgttttcccactaagtaatttcctaccactgtaagttcagctaattcagcttttccacccagtttcctgagtctgcaggtcccaagaacatgtgtttacttcttttccacccttctcagaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgtacgttgggcccatggcatctttgggggtggtccccagctgctctatgggaatgagacttcatttctggagccataggactatgagggaggccaacccctcgggggtccagtgcagtcctgaggctcacacagttccttgaagagcagcccccccaccccccgccccactccctgcactcagtggagaatttttttaaatctctccactatctgtgccccctgcaaatcaccccctaatccagtcattttagaaacctgccagccagccagcactcatccatatttatacctgatgagtgataacaaggggtttttatttgaccacctatatttcttttctcgaaagatcaggctgggaaaacatttttgttactctcttttttttttaaacaactatgctcaccccaacctgttgagccactcttccacttgcaaattaaaatgactggttttctaggagaaatccggcttaagcagccttatggaagtgacctagttcatttaaccgagatgaggttgatatagggtaagatgggggaaggagggaaaaggatgtcaaggaacaaaggaaacctgaactggtcccagagagatctcatctgataggctgttggttgattctcacactttgaagcagttgtcccgtgggcccacccaagcctgccccctgtccgtttgccctgtctctgtccccagctcccctcccttggatacgatgctgtcagtgtttttagtccttcccttaatattattttttaaaggttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaacta

SEQ ID NO: 445 - DNA, 14647 bp, Homo sapiens
tatcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacaggtgagaagacgtccccgcactgtgttcagctgggtagtcccatgccctgcaactcagggctgctctggggtaggaaagctgatggggaggtgaagaggaggagaagctgagggcttgcgtcaatgcatggaagagactcatccagtgaccgcctgtgtatggccttaatctccagtcctcaacaagtcatcctcctgcctccacctccacggaggtgccttcccaagtcccaggggtcttcttgtgttgcaaaagagcaggaacctgcagttgtggtttgtagctcaaagcgccccaggacttccccaggggactgaccatcactgtccccaagagtttttctgtccctttaaatcagcccttcgtgatgttcatgtaaaactgtagaccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgtctccagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatgtgaggcctcctggggtcagggctggggagaggtgggagcgggaggaaggcccagcattagggcatggccagtgccacatcagtagcaccgaaggccattgtggatttcttcacttggatgatgatccatggggactgattccctgggtccccatggagttggctaagcaggcccccatgtacccaaatgtcagagttctctgcagaaggaaagggctgggagtgaaagcatcatcccacactgaaggcccctgcttctgctctcagctgggcagcttactggctgtgtacccttaggcaagttacttaacctctcccagccccagttccctggtctgtaaaacagatggttcttcctccactgcctctcctacaatgtatttataagaatcaggttagtgcaagtaaaatcaaatgaagtagccagaggcttggtttgatttcctccttcatggccatttctctgctccttttaccttttattttccagcgttgccacttcctaggctctgtaaactccagtctgtattaccccaggctctggcccctgggagctttcccctggcttcctggtgagcacccttgtccctccccaccacccacaccctctttccttctcactcttccttgcagatggaatacttcggcactatctccattggctccccaccacagaacttcactgtcatcttcgacactggctcctccaacctctgggtcccctctgtgtactgcactagcccagcctgcagtaagtggggccaggagcaccagcagagaatgtctgggggctagtcctgggaggccaagcctggtactctggggaaggggggcttaggttccagaaactggccatccctgccacaccagcttccactctccatctttgagtcagccgtggaactgcttatagcagagatagagcaaagccaaggaagaactaaaatgtggctgctgtccaagagagtaactttcatactgatcagaattaatagaaagaaagccattgaaaagagaaatctttgacataatgactcacttcctttggaacacccaaaggaatgtaggggaagtttaatttaattggttatttctgagcagggaggtgagtcgggttctagtgtagatagtctgcttgtttcaaggaggcttggtagccttatctcctggtgcacacaggtggggctggtggggcacaatggcatgggtgggtccatttgtccagaggtaactcagaagtttcagtgaggattggaaaagaagagctacagaaagatgtcttgttcgatacaggacaagtcccagagacagaatgtctctggaaaccccaaggctagagatgtccatcggttgggagaaaagttgggagtaatttcctggggcaattgtttatccctgagtttcttttgaagccaacctctgacccacaatgggtggcagggactgtggctggcgcctgataaatgacacttatcttggtgtgcctcatgaggtcattgtggacaatcaggtttgctcagggatagctatttggtccccagttaggccacatctgtagctagagggaaatgtagttgttcattagggaggggcatcaccaggcttctaggggcccccactcagtgttgagagctgagggaagagaccctgccgctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtgagtgcaagtccttcattttttctctcttggacagaaacttgggagacttattcagaggtcttacatttcaaatctgcctcaggaatgggtggaaacaggggttagcactaacttctaggagaaagggcaagcaacactccccacctgagatggtggcagtgggtcagtctccacagcacgctgggccctgggggagagcagcacagggggactctggcaggaagcagtgcccagtgcacaaagcctggtggcagggtgcacagctggatctccagtctctagggcattgaggagataaaaccacgtctccgtcttgaaggataaagaagtccacaccagggggagagatttggactcagtaacataagggggcaaggtctgaaatgggagtccaatcacagaggcaaggcagaagcccagttgtccaaaggccaaggtccaaactgaactcagtgctgagctcatgagctgttcctcaaactccctctgacctctgaccctctgactccctctgaagtcctatgggtcctagaactatgggaatcagacaaatgtggggacagagagccaggtactttttcaggcttatagacagcaatatatgcctgggccttgggagaaagagaggttgacctactcctggtgaacgttggtccctggggtattcccgaggccagcagggcacagccttcatcaacatcccttagagtgggtggagtaggacatattatcaactgaaagaatgccagaagcagaaaaacaccatctatgtaaaaatatcatacagataaaacaatgtactgtattttctattggaactatgtatgcgtgtgtatacacacattacatatataatatataatatataatatccatatatgaatatatgtaatatacagtatatttgtatatataatatatatccatctgtatatattatatagatacaatatgtaacatattaaagtatataataattgcataattatatcatataatacatgttatatattatataattaatataatatgtaatacattacattaatatatgttatataatatataatatattatagaatataattgatataatgtattatattaataatatagtatgtgttatataatatattaatatgttgtatgtaataatatattacataatatattatgttaatctattatataatagattaacctattatataatagattaacataatatattacataatatgttaatctattatataatagattaacacaatatatatgtaatgtgtatatattatgttatatataagattctatatatattatgacatatacatatatattatatatctaattacatataatatatatataaaagttaaaatgactattttgaaggctacatccctaactgatcatcacagtaacctctgagatgcagggaagggactgaaattagcatagaaaggggaattcaagcctatagcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacattagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataactttaataatgaaacttgaaaaggacattataacaaaagaaaatataaaattacagaccaatctcttctctcatgaatatagatgcaaaagttctaaatgaaatactagcaaataaaatcttttggtatataaaaagatcataccaagggtcatctttccaggaatttatcatttaacagaataaaaggagaaaaatcatatgaccaatatgattatattagtaggttaataacattcaatatctattcatgacttcaagaaaaactcttagcaaactaggagtagaaagtaactcccttaatctgataaaaatgaaggacttcatctaaaagaagcccacagcaaactttatacttaatggtgaattgtcgagagacttctccataagatcaagaatgagacaaggacactcaatctcaccacttctattcaacattgtactgaaaatcctagccagtgcaacaaggcaagaaaaaagaaataaagaacattaagatggaaaaggaagaaataactctgtcaatattaatgtatgacaagattccataagtagaaaatccaaaaatatctacagaaaggatattgggattaatatgtgaacttagcgaagttgctggatatgaggtcaacataaaaaaaatcatctggggccaggcacagtggctcacgcctgtaatcccagcactttgggaggccgaggcaggtggatcatgaggtcaggagtttgagaccagcctgaccaacatttctctactaaaaatacaaaaattagccaggcgtggtggcacacgcctgtagtcccagctactcaggaggctgaggcagaagaactgcttgaacccaggaggtggaggttgcagtgagccaagatcatgccatggcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattttcagatttgtgatgctcaacctgtagcaagtaaaacaaatggcaaatagatttttaatgacactatttataatactatcaaaaccatcagctactttgatgtaaatttaacaaaaaatgtgcgagaactctactctgataatagcaaacattactaaataaaagtaaaagacttgcataaaaatcacaaacattaatgaataaaattaaaagaagacctgtattgaaaactaaaccatgctcatagattgaatgactctgtttcattaaaaagtcaaattttttcaaattggtctatacaaccaattttattccaatcaaaacaacagcattttttcttagacattagcaaactgattctaacatttatatggatatgtaatacaccaatacaatcttgctgaagaaaaacactggtaaatattaagatttattataaagttacagtaatgtagacgtgtggtgttggcacagaatttaaaaaataaacaaatgtaacagaacagaaaatacaaaactatcaacacagtcatctgacttgcgttgaacaagatactgcagtatgtggaggaaatgatggtatatttattaaatagtgccaggtcatatgaatatccagatagaaaaaaataaatcttaattcctaccttacacattatcacatttcatataggttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttgggaatatagcaagcatctttgtgctcatttagtcaaggaaagttgggaaggagaggcattagcttcaagacagaggaaaatccaggagtcaaaccctttgccagcaatcccctgtgccattctcctgttctcctgtgggctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcaggtaaggcccatcaagtctgtgaggttaaagtcagttataactacagggagacaacacatacacttgacttagcagtcaaaagacctggtttaggtagcttggtccattaccagctgtgtgatcttagtcaaaacatttaacctctctgaatattgaggaaatgggatttgcttcatcaagtagctgtaaaaacactttgtaaactctaccacactggcttaaatttaaggaatctctgggattggttcttcattgatgctgtcactaaatatcaagctcctattatatgctgattatgatgctcacactggggacccagtgaaacaagaaagacagtacctgcaggaggaggaggcagaaaaaaatgaaaagctgacaataaaataattgcatgctgatggatgaataaacaaaatgtggcatatccaaataatcaaatattattcagccttaaaaaggaagaaaattctgagacatgctacaacatagaagaaacttgaggacataatgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaagttgtctagacacctctgcttccccttgcagaacttccttctcccgtcgcctgggaaaagtgggctgtaatggagaatatcaaggcttggcagtcagactggcctggatttgaatcctgccacttacattgcttcatctcactgaggctcagtttcttccacggaccactaggttgatgtgagttaaataagtttagacagataaaatccccactacacggccttgcaccaaggtaatcaacaaatgtgagttcctttccccactccctctgtaaaaccactgtcctaaaattcctacaggtattcactcctctccctctttaccaccctgatttcagttttgtatctttctgatccttttcctcctcaaaatgaatctgtcttaggtcctatttctccagagtcctgctaggttccagaacataatctgagaaatcaataccaatgaaaataagttttcaggctctagtaagtcatgatacattcatattagcctctttgccttaacataaggagtgaataacacaaaaacgccaggcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaaccttgtgtcaaaaaggcccagaccaattcacttgcagtagtcagagtcccggtctcaaagcccagactgatgtttctgcctacctgtgtgcttggcatgagaccaagaagcaaagggtcctagctgaggctcacccctagagttttgcagtggcccttcctggacagtttgtctttctctccatgtagtaacccagaaggtggtgcggggagcgagctgatttttggaggctacgaccactcccatttctctgggagcctgaattgggtcccagtcaccaagcaagcttactggcagattgcactggataagtgagtattccccatgaagtagtgacagtactaggggtaaactgaaaagaggcacaactcaaaccgatttaactgaaaaaccactggtcactagcagaggatgccagaagcttactgtggttggaggtatggaggtgctgagcaagtgtgcaggaagggacctctgtaaccagggcagcagacacagcttccttccttgtacacatggcgtgcttttaactcaacatacagtcaataccagtgcacagcctgctcccctttgttcttttaacattaacacacaaggcaagggatgagtaacatggggggttgcacaggtgaattgggctcagatcttgtcctcaaaaaacttgtacagaagatgagatgcacccaaaccactatcctgtaaaatggaaggtggtcagtgctccaagagaggtgccaccaatgtggtccagcagacaggcatgaccgcttctatctgaatgctccagtgcatcatggagggggttacattgaaactgagccaggaaatatatacaatatctgggcacgaagcaattggggaagtgggactacatgcctgcctcatacctagcgccgtgctagacaatgcaggaattggaaaagtgtagttcaagtttcaattcagctaggattgagttcctgcaaggtaccaggcattaggaatgcaaaaaataaaaggcctcaatgctcactgtctattcagagtttttcaaactgtaggaattcacctatttatgggtcatgacatcattttagaagatcctgacctgaccaggtgtggtggctcacacctgtaatcccaggactttgggaggccgaggcaggtggatcacaaggtcaagagattgagacacctacattttttagacgaattggaatacagtagaaaataccagagtgcacttcaattgcatgaatgtgtgtgtgtgtgcactgggtcaagaagtaaacagatttcttcctatggatctcagtagaaaacaattgaggaacactcatatggtgggtggaaatcattgatgtgctccaggcatttgagaggccaaaaaagagtgggagtttcctaggagccgggggagggaaggtgggccgaccacaaccctgtcccctcagcatccaggtgggaggcactgttatgttctgctccgagggctgccaggccattgtggacacagggacttccctcatcactggcccttccgacaagattaagcagctgcaaaacgccattggggcagcccccgtggatggagaagtgagtgcctgcctgcgcaagggagtggtggggacaggagagccaggccttctcttgggaggtggcaaggctctaaacggatcctccgtattgggttttagtatgctgtggagtgtgccaaccttaacgtcatgccggatgtcaccttcaccattaacggagtcccctataccctcagcccaactgcctacaccctactggtaagaactgtttccttattctgcaggccacagggccctccccacatgcctgccacttccccttttcaatcgcctgcactttgcccgcctttaccctaagccccgccccacgttgttctgctctcatgtggcattccctctgggagggacacagctgcctgtggtggaaagaccacggggcttgctctaatttccagttctgccatgaagcagtagtgaacttcaggcaagccatttaaggaagtcttctgatattgccatgtagggcttttccactgacaaagtttaatctcctcaaccaccaggtcagactggagctattactatctcattttataggtgagaatatcaagactcagagagtcaaataaatggttcaagatatgagctgtttgcagggaggagtggagaataagattatatttgttctaacttcaaattaacattcctcctctagcaagaaaatgtcttttgttgcagtaaattctcaagtttgtagggtgaagtagaaagggaactcccagaccttttggacacctatgagcacctcacaccacagttggtctgaattttcagcattctaggtattcggcaccacacttcaacacactaatttttccaagagtcactcacagcatcagggtgactgcatcagaagaggggtgctaaggtatagactgagggcttcagccctacccctaagcctctattaactccttcccaaagccaccaacagacaatccaaataaaaacaaatgtttgctttaaaacacagcttcatggtaagtcccctaagctcctgccacatagggattatggagctgccactctgaacaccacactgaggaccagtgagacatttagactgagccctgttcatcagtccacatgcccatcaacaccccagcacacccacactctcaccttcccccacgtgagttgagtccctgcccaggtggaaatcactgatgtgctccaggcgctggagagcccaaaaaagagtgggagtttcctagaagccaggggaggggaggtgcgtggttctttcccggtatggtgagtggttcttttagaagatcattttagaagatcatgacctgaccgggcatggtgactcacacctgtaatcccaggactttgggaggccgaggcgggtggatcacaaggtcttgtgctggttctttcgcagtacagtgagtggttctttcccaccagcagatttcaatcagagccaccttgatccatcaaaactgctgtaaaaattttgacttttcacgtccttcctctcaagaagtctccctgagccctctgcaaattttcccacaccctcatcagcaacttcacatttcaaatcattgttggaaagaccacacttgcctggtagagcacgtctttgccaaactaaaaattagattggagaaggtgacactcttctcttgaacaaggaatgcctacttgcctcatctaaagggggtcactcaaatgtttgtttccagaacatcaacaagaaaatagcagtggatagccactaacacagttctttctctcccttaacaaaaactaagctgagcttcactagaaactaaagaaaccagaatttaaaccaaggtcttccggtgccaacccttttgctcttctagccatgcagcaagggtttcccagttgtaaaatgatggtgacaggggtaggtgggagtatataacagatgaacagttctcaaaattgtagaacatagaccccaggcccataagaatggacttgtgcagacaaacactttattaagcaacctagggtagggacatatgaagcaggaggaagaacccaccgaccaaaatggtggaacccaccagctgtccaaggccacccagtgccagccaccaccaccacacaggcagcctccaggcagtactactaccttcttcccccgtttgtcatttgcatccttctttccaacccacaggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 446 - DNA, 14647 bp, Homo sapiens; identical to SEQ ID NO: 445

SEQ ID NO: 447 - DNA, 83522 bp, Homo sapiens
ggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaaatgttgcgaatcagtatgcagttagcccattttatttgaaagtatagaaacacagacaataaaaaaatgatcaaacaatctggaagtacacacgttaaatctgggtacatataaaatcatcaaacaatctggaagtacacacatgttaaacctggatacataaaaaattatcaaacaatctggaagtacacacacgttaaatctggatacatataaaaatgatcaaacaatctggaagtatacacacgttaaatctggatacatataaaaatcatcaaaccatctggaagtatacacacgttaaatctggatacatataaaaattatcaaacaatctggaagcacacacttgttaaatctggatacatataaaaatcatcaaacaatctggaagtatacacacgttaaatctggatacatataaaaaatcaccaaacaatctggaagtatacacacgttaattctggatacatataaaaatcatcaaacagtctggaagtatacacacgttaaatctggatacatacaaaaatcatcaaacagtctggaagtacacacacgttaaatctggatacatataaaaatcatcaaacaatctggaagtatacacacgttaattctggatacatataaaaatcatcaaacaatctggaagtatacacacgttaaatctggatacatataaaaattatcaaacaatctggaagtacacacacgttaaatctggatacatataaaaatcatcaaaccatctggaagtatacacacgttaaatctggatacatataaaaattatcaaacaatctggaagcacacacacgttaaatatggatacatataaaaatcatcaaacaatctggaagtatacacacgttaaatctggatacatataaaaatcatcaaacatctggaagtatacacacgttaattctggatacatataaaaatgttaatcatttctttaagagattgttggggaaagtgcttttctttcataagttatggagatttttgtgatgttctgagttttcttattgaacatctattacttatatcaaaaaaataaaaaatttaggccgggcacagtagcttacacctgtagtcccagtactttgggaggccaaggcaggcagattgcttgactccgggagtttaagactagccttggcaacattgtgaaaccctgtctctacaaaaaatacaaaaagttagccaggattggtggtgtgcacctgtggtcccagccacttgggaggctgtggtgggaggattgcctgagctggggacgtggaggttgcagtgagctatgatcttcccactgtactccaacctgggtgacagagtgagaccctgtctcaaaaataattagataaataataatatctcagactatgcctaagctaagctagtgcttaataaaaaactacaaggtcaggcacggtggcttatgcttataatcccagcactttagggggctgaggtgggcggatcacctgaggtcaggagttcaagaccagcctggccaacacggtgaaaccttctgtctactaaagatacaaaagttagctgggcatggtggtgggtgcctgtagacccagttcctcaggaggctgaggcaggagaagcttgaaccctggaggcggaagttgcagtgagcccaggtcacataccactgcactccagcctgggcaacagagcaagactccaactctggctcaaaacaaaactaaactaaactaaataaataaataagaatacagcatattgtcattaaccatagtcactgtgctttacaacagaactcttgaacttattccttctaactataaacatgtattctttgaccaacatctcctcagctcccactccctaaagtaattgattttaaaaattataaatgcatgtgttagagaaggaagaataaacaatgtgtattttctattaaatgaaatgagaatttgttttttttccctctacaagtattgcttacaccttaaaaataataatttactgatttttctgtttctaatttggagattatgattacttgggaattctgatagaagtagctttcaaaaaagtgaccattacagaggcaaataagatttgctgggcaaggtgcggtgactcacgcctgtaatccctaatccctgcactttgggaggccaagatgggggtattgcttgaggccaggagtttgagaccagcctggtcaatatagtgagaccccgtctatatatatttaaaaaatttttaggctgggtgcagtggctcatgcctgtaatcccagcactttgggaggccgagacaggccgatcacaagttcaggagttcgagaccagcctggcctatatggtgaaaccctgtctctactaaaaatataaaaattagctgggcatggtggcaggcacctgtaatcccagctacttggggggctgaggcaggagagagccgagatcacgccactgcattccagcctgggtgacagagtgactccacctcaaaaaaaattttgtttttaataataaaagatttgcttagaagattagaaacaaggggagatgactcatacctttatattgtttgaatttttaacaagatgtggattgcattataataggaaatatatttccattaggtaagattttttttaccacttagtttagaattaattgtagattcaaagaaagttgaaaaaaaagctacttttagggaaatcccttcatctagtttcagagttttaaaaccttttatatttctgtcttttcagcgtcctgtttggttggccttcctttgtaaataggaattatttaattgagattataggtttatgatcattttatgtaaagtggacatttcattaaaataaattcagaattagagctaggtattgagtagacagggaggtatggattttgataaaagtttagggataataaagattaaattgtactgtgtttatagtgtagattttactataagattaaatgccactacagctaactttgtctctgttctggctttctgatgtctcccgtgggtgcagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggtaatctttcctccgggacttagtttccaagatctaatgtgggaactcttaaagcaaactgtatttttagtgttaagattacaggaatcttgcatttgccagattgcctctggtagacaggaatagcatgctgcctgggtttggagtggggttaggagaccgtgattagactgttattaatgtgataacccaagtttttagtcaaagtgaaagagagaaaagtgaagcacttcgtttgacttttctgcctgccgttcctcttccattttgatcctatcgtttttgcctaaattccaaagaaaaagtctgctgtcaagtgggccaagtgtggtggctcacgcctgtaatcctagctctttgggaggctgaggtgggaggatcacgtcagcccaggagctcgagacccgcttgggcaacatagtgagaactcatcttgacaaaaaataaaattggccaggtgtggtggcatgcacccgtggtcccagctactcagggggctgaggtgggaggattgcttgagcctgagaggttgaggctacagtgagctgtgatcatgccactgcactccagcctgggcaccagagtgaaaccttgtccctcacaaaaaagaaaaaacaaaatggctgggcgcggtggctcacacctgtaatcccagctctttgtgaggctgaggcgggtggatcatggtgaaactctgtctctacaaaaaatgcaaaaattagccaggagtggtggtgtgtgccggtagtcccagctgctcaggaggctgaggtgggaggattgcttaagcctgggaggtggagcttgcagagagctgtgattacaccactgcactccagcctggaccacagagccagaccctgtgtccaaaaaacaacaataataatgataagtccactgtcaagagaattttctttccaggtgactcctgctctaaggcaacaatttgaactttaattttaggacttctgtgctaaaactgtgaagaaaggtgttaataatgactgttcatctaattgtcatgtaatttgttatatgtgattcacttagctaaacatcacttagacattcagagttctcttcatttacaaaagatttcaaacatttttcctgtgaagcagcttagctttgaaatgaaaagttatatatgcagaagattgcctgtcacacactagacaaatcaagtaaaggcagtagaaattgccatatgtctcagaatagattgtatataacattctcagatctaggtgagattagatttgagattagcgattagctgacttcaaagggagtcagctagtctttttttttttttttggagacatagtctcgctctgtcacccaggctggagtgcagtggcgtgatcttggcccactgcaacctctgcctcccgggttcaagcgattctcctgcctcagcttcccaagtagctggaactacaggtgtgcgccactgcgcccaactaatttttgtatttttaatagagacagggctttcactatgttggccaggctggtcttgaacccctgacctcaggtgatctgccttccttggcctcccagagtgttaggattacaggtgtgagccactgtgcctggcctcagctcgtgttttgaccgatagatggatgtttaacacctcagcagtggtccttttatgcacaggaattagttaactaacttctcctagatttgttaaaagaaaaagcagttaccttcttttttttttttttttttttgagacggtgtctcactctgttgcccaggctggagtgcaatggcatgatctcggctcactgcagcctcgacctcctgggttcaagtgattctcctgccttagcctcctgagtagcggcgactacaggtgcgcaccaccacgcctggctaatttttgtatttttagtagagacaaggttttgccatgttggtcaggctggtcttgaactcctgacctctggtgatccacctgccttggcctcccaaagtgctgggatgacaggcatgagccaccacgcccggccttaagttcttctttttcaaggaagtgaaaccttccttcacaattgctatattgcattaattcatttcatgaatatttgagcggccaacagatgaggtaaacaaagtatagatgtgtatctgcctcatggaacttatgaattgcagagggagacaggtattaaatattcctgcaaataaatatgtgatttcaaagtatgataaatacttcatagaaaataaatagaatgttgtaacatagaggagaataaaagaggaaacaccttgtagatcaattgaacaaggaagacctctttgagaaagtgaaacgttagctgcaacctgaacattgataggctgtagccaaatagagagatgtggggagagcttgtgaaggcagaagccatgtacacctgttgcttcaggagcccctcagtggacactgtcggaggacaggtgctttgacaggcagacaggattgttttcttccaagtgctgcaggaagcccctgaagagttttaagcctggaagtgaaatccattttatattttagaggtcactgtggcaatttttaaataaaagaattgtattcatactttttctaattctgtgtctgttgctattacctatgaagaaaatataaagtatttaacaatttaaataagataaatgtactttataaatagtcagttatactttgatgaggtttgtggtgtttctatgtaagatgttaagatagtggtaggagaactgagcttggggttcctcagcattgttcattggctgcagcttttgaaagacagggaggcgcatggtggaactgaattactctggactcttgagtcctagtctgcctttggacttgcaggttctaggcacagagagagatgtagaagtgtgtagattctaaagggtgtagaatttggaagaagatgatgggatggtagaaatatttatgtgaatgtaggcagtgttggagcaggagaaagggaatagcaaacagataagaagggccagcgactttcagcaatctgaaccactcatttattgccccatttgataactgctttcctctctacctgcttgtctctgtgcccgtagatatactgaaatgctgaagttaaatatggattttgcaactaaaatagtgttagaatttgagcctttcagttcgttcttttttgggtattatattgatatatttcaaaaattcatattaaagtataatcaagtatgtccttttgtggaaacaggggttgatttgccatgccataggaaagcagaggatacatgtcttaaaagtaagatagtgatggtacaaaattgcattggatactttgcaaagatttttctgtccttgagcagtatttgatggagaagtaaatgttaataaatattgttctggaatgtaatttaaaaattcaatgtctgttttgacaggccaatagcaggatatgctaacctgtgtccaaatatgatctctacccagcctcaggagtttgttgggatgctgtccacagtgaaacatgaggttattcatgccctggtaaattctagccttactgttctttccttcatgccttgattttctgcttagtatgttctcatttttatacatatattccactttaagatgatgtggattcctagactcatgttcgtgcacatgtaccctaaaacttaaagtataataataataataaaaaattcaaaaattagcggggcatggtggtgtgcacctgtcgtaccagctacttgggaggctgaggtgggaggatggcttgagcccagggaggttgaggctgcagtgagccgagattgtgccactgcactccagcctggtggtagaggccgactttgtatcaaacaaacaaacagaaagatttataaagctttttcctcttttaaaattctaagattgaaaaatgaacaatactgaaaggcctttggaagtatatagatacggcagagccctgggctgctgctgctgctgtttgtttgttttttgaggccccatgatggcccactgcagcctcagcctcctgggctcaagtgatcccaccttagcctcccaagtagctgggactacagacatgtgccactacacttggctaatttttttttttgatagagataaggtctcgctatgttgcccaggctggtctcaaactcctaggctcaagtgatcctcctgtctcagactcctaaagtgttgagatgagaggggtgagccactatatccagccctctgctgctgcaacctcctgggctcaaatgatcctcccacctcaacctccagagtagctgggaccacaggcacgcaccaccatgccctgctaatttttgtatttttagtagagatgggggtctcgccatgttgcccaggcaggtcttgaactcccgggctcaagtgatcccccccgcctcagcctcccaaagtgctgggattacaggcatgagccaccgcgcccagcccttctgctgccgcttctgataaccatgtgaaaatccttatagggagaaagtagtaatgacttgccacttcctcaaattaaaggaaaggaaagtgtcagctaaatatttttttacatgtttatttgaacacatacgaatgtttatcttcccagtaatttttaagtaaatttattgtaagcaagtgtcagtcttggccacgtatctcagtgtccagcttccatcttttcagctctggtccagctcttgttcagaagtgatacctgatagctgatagcttctcaaaaaaggaagaagggccgggcgcggtggctctcgcctgtaatcccagaactttgggaggattcttctatatatataagaaggccaaaataactttaaaacgcagacagactttcaaaaccatttcataatgtacacacacacacacacacacacacacacacacacacagagcaaacaggaattaaaaacacaacagctggtgttctttatggttttaaaattctagtcgtgcttggaaatataattatacgacagtaattaatgtttgtagtatttctactgaatataaatttaaaatatataatacattttagaaaatttctcgttagaaatatttacctcaagtaatcagaatttaaaatttataaatatggaacacttaattgttgttcaattccagcgtaggagaagttcctacagaagcactggcgtggtgcttctacgttcccgttagtatcagtgctctcttttgatcgcaggcctgtaatcagccttgatgtttttcacttgaagacattttgaactttttcttacagggtttctctgctgggctgtttgcattctaccatgataaagatggaaatcctctcacttcaagatttgcagatggcctcccaccttttaattataggtatttttgttgttgttgctcttgttctcctcttttaggagggtgctaagactagaatctgagaatcacagtatattagatgccataaataataatgtcttcatggcaaacctaaggaaattgtagatattaaaacaaaatgggatataagaggccattttatgaaaacataacttgtgagatgtaagtgaggaggagagagatacccacacacaagaaccattcttaagctgataatttgcagtgcttccttgcattgaggatattcctcaaaagcatcaaaccttccggccaggcacaatggctcatgcctgtaatcctgcactttgggaggccaaggtgggctgattgcttgagcccatgagttcaaaacctgccgggcagcgtggcaaaaccctgtctctacaaaaaaatacaaaaattagccaggcatggttgcatgcgcctgtagtcccagctacttggggtgctgagcagaaggatcaattcagctcaggaggctgaggctacagtgagctgtgatgacgcatctgcactccagcctgggtgacagagtgactgtctcaagaaaaaaaagagaagccttccagtaaaaacgaagataatagagtaataaattcagttgttacagatataaagaattggattttgctttaactgtatttggggaaactgttaatcttgaagtatgaatgataaagagagattggagtgattaataaggtaaaaactttattttctggctggctttgttcactacttatgtgtaaacgttgccttgccatggaaaaacaggaattaaaaacaacctctctaaggcatggttagatgaacagataacgtgataacaaatacaacaaaatgttaattacagaatctaggtgagctggttgattataagggtgtttagtaaacaattcttttaatgttctgtatgtttgaaaattttttttctttttttttttttttgagacagtctcgctctgtcgttcaggctggagtgcagtggtgtgatctcggctcactgcaagctccgcctccagggttcacgccattctcctgcctcagcctccctagtagctgggactacaggcacctgcaaccatgcccggctaatttttgtatttttagtagagacggggtttcaccatgttggccaggctggtctcgaactcctgacctcaggtgatctgcccgcctcggcctcccaaagtgttgggattacaggcatgagccaccgcacccggcctatgtttaatatgtttgaatttttttttttttttttttgagacggagtctcgctctgtcgcccaggctggagtgcagtggtgcaatctcggctcagtgccagctccgcctcctgggttcacgccattcttctgcctcagcctcccaagtagctgggactacaggcgcctgccaacacgcccggctgattttttgtatttttagtagagacagggtttcaccatgttagccaggatgatctcgatctgctgacctcgtgatccacccctctcggcctcccaaagtgctgggattacaggcgtgagccaccgcgcccggccaaaatttttacaaaacagtattggaaaagaaaaccctctttatattttctgttcttttactgagaatgaaagatttatagggaaaatggtagaagtagtctagggaataagccagaaaaaaaatgacttaggttacagggaaaaataaaaattgatatccatcgtaattttctataatagataaatgtgttacttttgtagtagtgcttttatttatgcagggtagatttcccaaactgggattgctgatttaaaatctgtttacactataaattttaatagaaactgccatgttacattttttttaaaaggtatagcaaagcacattcccaccaggtgtgtatgagtgcttttgttaccactttatcagtatcggatattatagatcttttttatttttaagcccaatttgatggattaaaagatggtatctcattgttgtatttccaggactatagtgaggttttagccatttgcattttctctttgtacactgcctatttattttccttgtccagtcttttaggttaattttccctttctaatcacgttgtaggagttctttataaattagagatattactcctttttcatgcttattataaatatttctcctagtttatctttttatttcatttatcatgcttttgccatgtatagaaaagtttttaagttttttatcattaaattcatctatctttttttttttgagatggagtctcactatattgcccaggtgggtctcgaactcctgggctcaggcaagcttcctgcctccgtctctcaagcagctgggactacggtcacatgccactgtaccccgatgtttttttctttgttgcttaaggcctcaaaagattataaaaatattctcctacatttattctagtaaattattattcgatttctttacatttatagcttcaatgcatttgaaattttttttgatttatgtattttgggattcttttgtaaggtgcatatatgtttataattgttatatctttatgctggatttaccccttttttttttttttttttttttttgaggcagggtctcactctgttgcccaggctgcagtgcagtggcacaatcatgatcacggcttactgcagtgttgatcttcccaggctcaggtgatcttcccacctcagcctcctgagtagctgggactacaggagtgtgccaccatgctcatctagttttttatttttattttaaatttattttattattttttgagatggagtctcactctgttacccaggctggagtgctgtggcgcgatctcggctcactgcaacctccatttcccaggttcaagtgattctcctgcctcagcctcccgagtagctgggattacaggcatgtgccaccacacctggctaatttttgtgtttttagtagagacggaatttcaccatgtttgccaggtttggtctcatactcctgacctctagtgattcgcccatctcggcctcccaaagtgctgggattacaggtgtgagccactgcacctggcctatgtagtatatctttttatccttttactttccacctatttgtgttatttagtctaaactatgtctcttgtagatatatagttagagcatgtttttaaattcatttttccaattaaccctgttctgtctgctacagtgtctgtcaggttactggttttcaccatgattgtgggctgtcggttttcaaggctgcccaaaagctggagagagggcatggaaacgcaccacaccgctcctgtttctacggagattcatcaatttttcatgaataaatgctttctgcattgctataaatctttgattaatttccaaagtttaagaagttgatttcaccaagttgggtggtttttttcattgcttttttcatagaggagagaattttgagagatttttacgctgtcatttttgcttctgactttctggaatttatttttgtatgtggtgaaaaagggatttaaccttttttttctaaatggataatcagcacagttgttagataaattctactttcccactaaattaatatggcattttgttggttatgtttccttatatacttggatatctgtgaacttgctttcattttatcctgtacacttgtcaaaaggaagtaattcatcgtcatcttagccaagtgctagctatgtgaacttgaacaagttacttcatctccctgaacttttgtctctttatctgcaaaatagtgatgataatctcatagggttgttgaaaagatgaaatttaaaacacttatcagggctaggcccagtggctcacgcctgtaatcccagagctttgaaaggctgaggtggaaagatggcttgaggccaggaattcgaggccagttttggcaaaacatagcagatcttgtcccaacaaaaaataaaaaataaattgaaaaaaatttttctggactggatttcattctgtcacccaggctggagtgcggctgtgtgaacatagctcactgcagccttgaactcctgggctcaagtgatcctcttgcctcagcctcacgagtagctgggactacaggcacacactaccatgcctggcttattttattttattttattttattttatttattttgtttttgagacagggttttgctctgtcacccagtctggagtgcagtggcacgaacatggcttactgcagcgtcaacctcctgggctcaagtgattctcctgcctcagccgcctgtgtagctgggaccacaggcctgcactactgcgcccagctaatttttaaattttttgtggagacaaggtcttcctgtattgcctaggctggtatcaaactcctgggctcaagcagtcttcccacctcggcctgctgaggtgctgggattacaggtgtgagccactgcacccaaccaaaaaattaaatttaaaaaaatgtagaaaggaaaatacttatcaagtactttgtttggacttgatacataggaggttctcaaatattttaatttcatattgatatttataaagactttttacagtaaatgtaaatatttttatatttaaaatggtgaattttcagtaataattgtgttttaattctataattacagtctgggattatatcaatggagtgataaagtagttcgaaaagtggagagattatgggatgttcgagataataagatagttcgtcacactgtgtatctcctggtaacgcctcgtgttgttgtaagtattatcagacttcatgtctcatgagccatctgttcttttcctttactgtggtcctttctttactcatcattattgtttaagaacttataattagagcctatagtaggaaaagtcatataaagggaatgcaatgaagctacgggccacgagaaatctgaggaaatggaaacttggcaatggctctcacagctcctatcccacccagtgctttaggccagtgcctcctctgttgtgatgcctcttaggaccactggtactatttctataatgactgatcattttctttggtgtctgtattagtcaaggttctccagagaaacagaaccaataggatgtgtgtatatatctatacatctgtatacacaaagaaagaatacgagagaggaggggaggaagagatttctttttttcttttattttctttctttctttttttttttttttgatacagggtctcactctgtcacccaggctggagtgtagtgttttcggctcactgcaacctctgtctcctgcgccaaagtgatcctcctacttctgcctcccgagtggctgagactacaggcacgcaccaccacgcccagctaattttgtttatttttttgtagtgatgaggtctcgctatgttgcccaggctggtctcgatctcctgggctcaagcagtcctcctgcctcagcctcccaaagtgctgggattacagacatgagtcaccacacttggccaagaggtaacttttgaggatttggctcacatgactgtggaagttgggcgagttcaaatccgatgggataggccagcaggctggagactcaggggattgttgcccttggagtccaaaggcagaatgacttcttattcaggggaggtcagtctttgttctcttccggccttctcctgattgggtgatgcctacccacattatggaaggtgatctttacttcagagtccactcattgcaatgttactctcattccagaaaacaccttcacagaaacatccagaatatctgggccaaatatttgggtaccatggctattctcctttccccttttccttgactttgtacagctctctgacttctaaagttctgcactgctcttgggctatttcccatctctgaaaatctctaactaaaggacagatagaacccaatgagcaaggttttattctactgagcaactttttttttttttttttgagacagtttgcctcttgttgcccaggctggagtgcaatggcacgagctcagctcaatgtaacctctgcctgctgggttcaagtgattctcctgcctcagcctcccaagtagctggaattacaggctcccaccacgatgcctggctaatttttgtatttttagtagagacgggggtttcaccatgttggtcagggtgagaccctgtctcaaaaaaaaaaaaaaaaagaaaaaaggaaatttcttcctcccctcatctcatattctttctctgtgtgtacatatatatagatgtatacacacatcctattggttctgtttctccggagaaccttgactaatacagacaccaaatgatcagtcattatagaaatagtaccacggatcctgaggtatcacaacagagggggcactggtgacctcaggtgatccgtgcgccttggcctcctgaagtgctgggattacaggcgtgagccactgtgtctggccagaatagatttttttggacagctaaaagtgaccaacctttagttagactaagaagatgcaaataacataagaaatgaaagaggagacattacagctgataccacagaaacacaaaggatcatgagagactgttataaacaattatataccaacaaactggataacctagaagaaatgaacaaattcctagacaaatacaacttatgaagactgaatcatgaagaaataaaaaatctgaacaggttaataacgagtaatgagattgaatcagtaataaaagtctgccatcaaagagaagcccaggaccaggttcactgctgaatttcaccaaatgtttaaagaagaactaataatccagtccttctcaaacttttccaaaaaattgaagaggagggattacttccagactttttttttaccagggcagcaatactctaataacaaatttagacaaggccataagaaaagaaaattacaggctaatattcttggtgagcataagtacaaaaattttccaacaagatactaacaagctgaattctataacatgttaaataggtcatccatcatgatcaagtgagatttatccccaggatgcaaggatggctgaacatagcaaatcagtaaatgtgatccatctcactgacagaatgaaggacaaaaaccatacgatcatctcaatagatgcaaaaaaatcatttagcaaaattcaacatctttttatgataaaaaactgaccaaattaggtacaaaaggaagatacctcagcacaataaaggccatataagagacacccacaaccaatcttatactcattagtgaaaaatggaaagcctttcctccaagatctggaacactcttaccacttgtacatagtattggaagtcatcgcaagagcagtcaggccatagaaataaataaaaggcatccaaataggaccagaagaagtgagatagttgctgtttgctgatgatcttatacatagaaaaccctagagactccatcaaaaattatgaggattaataaatacagtaaaagttgcaggatacaaaatcaacacacaaaaattagtagttttctatatactaacagaaaactacctgaaaaagaaatcaagaaaacaatctcttttacaatagctaccaaaaaaaaaattcttaggaataaatttaaccagggaagtaaaagacctgtacactgaaaactaggtgaaagaaattgacacaataaatataaaggtatcccgtgttcatggagtagaagaattagtattgttaaaatgtccatactacccaaaacagtctacagattcagtgctatccctatcaaaattccaatgtcatttttcacagaagtagaaaaaaaatcctcaagttcatatggaaccacaaacacaccaaaaaaaagaaaaaatagccaaaacaatcatgagcaaaaagaacaaagctgttcaggcagtgtgatgcctccagctttgcagtatttcaaactgtactgcaaaagcatagtaattaaaatgtcatggtcctggcataaaaataggcacattgatgaatggaacagaataaattatgattaatttattgacttgattatgattaaccaattatggttaattgatttttaataaaggtgctaagaatacacaatgggaaaaagtctcttcaataaatggtgttgggagaactggatatccatatgcagaagaatgaaatttgacccttatctcacaccatatatacaaaaaccaactccaaacatattaagtaaacttaagaccagaaactgtaaaactactagaagaaaacataaggggacaactacatgacattggtttgggcaatgagtttttggattggaccctcaaagtgcaggcaacaaaaataaaaacagacaaatgggattacatcagacgcagaagcctctgcacagcaaaggaaacaaaagtgtgaagagacagcctagaaacagagagaaaatatttgcaagccatacatcagaaaaggcgttaatatccaaaatatgcaagaaatgcaaacagctgtgtacaaacagcccatttaaaaaaatgggccaaggacctgaatagacatttctcaaaagaagacatgcaaattgtgaacaggtacgtgaaaaaatgctcaacattactaatccttagggaaatgaaaattaaaagcacaatgagatgtcattttatgcctatcagatgactgttagcaaaaagacaaaagagctctcgctttggcagcacaaagactaaaattggaatgatacagagaagattagcatggccccagtgcaaggatgacatgcaaattcatgaagcattccatattttaaaaagaaaagaaaagaaacaaaagataagaagtgttggtgaggatgtggagatagtataaattagtacagccattatggaaaactggaagttcttcaaaaaactaaaaatagaattaccatatgctccaacaatccttgttccatgtttacacaacagatttgaaatcagtttgtcaaagagatgtttgcactcctgtgttgactgcagcgctatttacaacagccacattacagaatcagcctaagtgtccatcagcagatgagtgggtaaagaaagtgtgttatacacaattgacccttgaacaacataggttggaactgctcaggtccacttatttgtggactttctgtcacctctgccaccccttagcaagaccaccccctcctcttcctcctgctcaatgtgaagacaaggatgaagacctttatgaggacccacttccacttgatgaatagtgaatatcttttcttactgatgatatttttataacattttattttctctagcttcattgtaagaatacatcacataatacatacaatatacaatatatgtgagaattgactgtgcagttactggtaaggcttctagtccatggtaggctattaatagttaagttatggggaaatcaacagttatacacagatattggactgaacaggaagttgacgccactaacacaatggaatactattcagccttaaaaaggcgggaaattttgtcatttgtaagaacatgggtgaaactggagaactgatgctaaaaaaggaacagaaagacaaatacctaatgttttcacatttcacatgtgacatctaaaactattgaaccccgaagcagagggtagtggttatagaggctggggtggggggagatggtaaggtgatggccaaagggtacaaaatcacagatgggtgtaacactttttttttctttttttttgagatctattgcacagtgtggtgaatatggtcaatagtagtgtattgcacagatttaaattactgagagtaaatttaaaatattctcacaaaaaaagtatttgaaatgatggctatattagctcgatataattatttcacattgtattcataaatcataacatcactctgtactccataaatatatatggttataacttaaataaaaaattttaaattgttattgacatgagttacaactgtcaatcatcctagtctataacattttttagctatatgttgcaaaagtgaaaatcttcagagagaagaaaagatactaagtagtaatttcctagcaaagaagagtgtgactgcattaaaatatttagttatattaaaaaccatattttaaaaagaaattctcctttctcaacaaagtaattctttaatgttaacttattatattcatgtgatgaaaagtttgctgttatcttacggtacttttgtaccatatttgtttctgattttttttctggttcttaggaggaagcacgaaaacattttgattgtccagttctagagggaatggaacttgaaaatcaaggtggtgtgggcactgagctcaaccattgggaaaaaaggttattagaggtcagtttgtttttaaattttcctagactttatttaatgaaaataattcataattatggtaaaacttattcaagcaggttataaactgaaaaatgtttacgtccctttaccccttcagctctccagatgcactttccagatacagtcactccttactttttttgtatatactttcataaatgttatatatgtatgtgtgtgcaaacacacgctgaattgtctattttttcatgggttcacatatttatgcaacttttttcactttttccaaggcactataggtgcttctgctataatgcaatgtatgctttcctgaaaaacctttttcttcacaattggacactaaaaataacaagacttgtgggaaaaacaagtaaacagatcactaacagaaacaaataagtcatatagaactatgagctccgttttaaaaagacatcagattttcaataaatgaagtcctgtatctactctagtattttattaaaatttttatgttttttagagacagggcctcactgtgtcatccaggctggagtgctgcagctattcacatgcatgatcatagcacactacagcctcgaattcttttgggctcaagcagtcctcctgcctcagcctccgaagtagctgggaccacaggcaaacaccactgcacccagcctactctagtctgtgtgttcgttcgtttgttcgttcttttcttttgttttttttcttttcttttcttttcctttcttttcttttcttttcttttctttctttctttccttctttctttctctctttctttccttttctttttccttttcctttccttttacttttctttttctttttccttttcttttaactttcttttctttctttctgtctcactccacttggtcaggctagagtacagtggcatgatttcagttcactgcagcctcaatctcctgggctcaaatgcttctctcacctcagcctactgagtagctaggaatacaggcaagtgccaccacacccagctaattttctttttgttctttcagtagagatgggtttcaccatgttgcccaggctgacctcaaactcatggactcaagcaattcacccgcctcagcctcccaaagtgtggggttacgggcatgcattccgcacctggctactctagcatttctttaccttcaacatcagcagcaataataacccatggtagctggatgagggattgtaaatctgagtattgaggacaggggtaaagtgtacatagacttgtgagaaccatacagtaaacacttgcacgcagagccgctggctacaccgagcagcacattatgcactgtacagcatttttgtattgctgtgtttggctgtcttagtatacttggtgtttaggcctcatcacaaaatagtcacatgcagggaaaaatcaatgaaccaacgtgattccttgttatactgatgccattcccttatttatgaatttcacatgagttcattcacatcgcagaaacacatgctttcacagaataaactgtatacttggatctacccatttttttctatatgaatgtagcataacagttctgtgttaatgaacacagttcatggtttaaattttgtgttttagaaaatgtaatgagcaacttatttatatctgtgatacccaggatggggtttcaggtggtgtttttagattcaactaagcagtcaaactcacaggacctaatcaagccatgttgagaaaagattcccttcgagaaggatattagaaggaatacacagcgtgccagcgcagtagagccaggcattcctcttgggctccacatagcagtggaagggctgtcatctgtgcctctctccctccccatgcagctcaagtaccagagcacaagaccacaatagacagatgggaggaccagcctggcttagaaagatcatgtcccaaataggaaccagtatctttttatttttagagatctgcttaaatagatagttgcagctcatatacatcatgcctaaagttaatacaattctggaaagaatgaaattagtgcttgtgattactgttcttgtctaggtgaccacaaagtaacaatgatggaaacttacggaagggacgtacatttattcctcccatgggaagtgtggtttttttttccttaagaaattttcttaagtgactccctttagaaagctgtacattggccagaaatgaaaatgtttgtgcttttcagcagaagcgctgacagtagtaatttcattaacttctctcaaatcaactttgtgtccttgaactattttttttttaaagcgtggtatcacagtacttgagatggccatctggtgttcaatggaaagatttaaagaacactcagaactgtccaaagatgaaataagctctgtaagaggcagtgaagtcctcatcattaggtgacctcctgataggaattgtatggtgtgaattaaaatattgggtagatggtagagcatgatgatattttagacctttcaaggaagtccttttaccccatgattctgtcccacttgttttgcatgttacacatgtttctgtgatcacagagttgaaggtgaggaaaacattttcagtgtaattcagacagctattctccctgaccccaaattatctgtgcatttgcctcaatcacccactttgctttacctggagagtataatatttctgtagcatttctgtttccatatagatttatcttcattcatcacagagttctaaatgccagctgcctgccattccaagggaattgaacacaatggaagcacttagggcagaaaatagatttcacttcaaggttcagtctagtcatcttaaaggtttatgtatttcaccacttttaagtgaatgtcttgtcagcctctcacagttgaaacattttaaatatgtatatcagaggaattgcagaaaatattaggagttgcagagaatctagtctaattaaaccctgttggtgattttcagaatgaagcgatgactggttctcacactcagaatcgagtactctctcgaatcactctggcattaatggaggacactgggtaagacagctgtgacaagaggatatgaattgcttatgaaaatgaaattaatactgagcttatagcttaagaaaatgctgacattttatgctgaagcaaaatatacttattaattatttgaatcttgtacagttagctgtccgttattcataccaactccattcattcattcgttcattcaataaatacttttgttgttggttttaaaatagggtctcactccttctgcgcaggctggagtgcagtggcaatctggactcactaatcctggacttcccgggctcaagcagtcctctcacctcagcttcctgcgtggctgggactacaggcacgtgccaccatgcctggctaactgtgtatttttaatagagtcggggttttgtcatgttacccaggttcacaaacttctgggctcaaatgatccacccaccttggcctcccaaagtgctgggattacaggcctgagccacctcacctggcctcaacaaatatttgaggccccgagacatagtaataattaggacatacccctgatatgatttgttttcgaataagcaggggctgagcccatatgaaggaaagagtaaacaatttttaaattataaaggaaagactaaacaatgtttaaattatgaaggaaagactaaacaatttttaaatgactggttttttataaaacaatggaactttcaggtaaagccatgaaatactgttttgtttatttttttaagtagagacaaggtctcactctattgcccaggctggtcccaaacgcctgggctcaagcaagcctcctgccttggcctcccaaagtgctgggattacaggcatgagccaccacgcctggcagaaatactgcttttaaatgaaatcttttatacaacccctacatataaaaaaaatgaaagctgctttagtggaagcgttgttacctcttactctttctaagacagtctgagagaaaattagaaaattgaatcaaatttgaaaattaatggtagaggtgctattaaaaccatgaaaattgttgacactaccttcactgttgagaggtgaaagaggtaaaagcatttaaacatatagaggttattctttctttttttgagacggagtgttgctctgtcacccaggctggagtgcagtggtgtgatcttggctcactgcaacctccacctctcagggtcaagcgactctcctgcctcagcctcctgagtagctgggactacaggcgtgcatcaccacacccagctaatttttgtatttttagtgtagatggggtttcgccatgtcggccaggctggtctggaactcgtgacctcaggtggtctgcccacctcggcctcccaaagtgctgggattacaggcgtgagccaccgtgcccagcatatctcatcgagttttatgagacttaaatgagtaaatatctgtaaagctcttagtacagcgcttggcacactgtgagtgccaactaagtatgagcatcatataaaaacctgagctaaggcttcatgaaacaatacttaccctgaccacctacagtgcagtcctttattgtattgagtttttatttttattatttttttttatttttagtttttagtttttaaagagagagaaagaaatgttaatcaagatccactacgttggtttgacaactcactaatactcagaaactctctgtttctaatgccccctctactccctcactagtgctcatccttctgagttgagctaaagttgcttcctcagaaaaaccttcccgaattcttcagactaatgtaggtgtttctgttactgtgttcctgttagcatcatatacttctcctttggaatattcatcacacttcaaatgttttgttttagtatctgtcttccctactagattatgatcttcatgagagcaggttctgtttattgatttactactgtagccttcatttaacaaagtgcctaccatgcgacaaatgcttaggaactgttgactgctaatacagaaagagctgcaaagaaacggttatcaggaaggtctcatgatgtgtagctggagtgcccacctgaggatggaataacagcgctgataagatattctgcgctcatcgacatgtaccttcacaaaggagtctacttactccacattttattcatagggctaagggcttctgaacctgagcactgctaaaataattgctagtgcacaacattaggggcacctgtcactatctggacagtttgaccttgctgcgataccaagttagctagtaacgtaactcacattgtagttgcagaagttgcaggcattttggcattggagcaccgcgactccttcagtttctgtctgagtgagagttttgttcgttgacaggagagaagttttggaagatgctacattacacatttgtttgattttgtagcaaggtggtacaagtggaggggataattcttatctccccaactttcaagcctatttttttcaatattattattttttattatagagatggggtttcgccacgttgcccaggctggtctcaaactcctgagctaaagtgatccacccaccttggcctcactaagtactgagatttcaggcgtgagccactgcgcccagccctgagcctatgtttttatttactgttttgataatgctaaaggaacaaaatataatacacacaggtaagagactattttgtataattttataacttttgcaagcaaatcttgtctctaaaaataaataaaaactaaaacaaattgattgctttcaattaaatttgtctggaaactccatcagtgctttcttttttctcttactagaacttttttttttgagacaaggtctcactctatttcccaggctggagtgcagtggcatgatcctgggctgaggtgatcctgccacttcagcctctcaggtaactgagactataagtacacaccactgcacacctggctaactttttgtatttttagtagagacagggtctcaccatgttggccaggctggtctcgaactcccaacctcaaatggtcaaccgcctcagcctcccagagtgctggggttacaaatgtgagtcactgcgcccagctaggacatttaaaaactaatggacataggctgggcacagtggctcatacctgcaatcccagcactttggcaggccaaggcgggtggatcacctgagatcaggagtttgagaccagtgtggcaaacatagtgaaaccccgtctctactaaaaatgcaaaaattagtcagacatggtggtgcatgcctgtagtcccagctagttgggaggctgaggaaggagaatcacttgaacccatgaggcagagcttgtagtgagctgggatcgtgccactgcactccagcctgggtgacagagcaagaccctgtctcaaaataaaataaagtgaaaattacaatagaaattttatacttatgtcaaagtataaaagtatttaatacctccatcataagcctggttatggaatccctgtgtagcagtccctgtgcggcaagaacgttgtgagtgatcacttacagtgatggcctctggcctccaaaatctttcttaaggtcctaatgtgctcattgttgagattctcaattgttatgctagagttgtttttgaaaggacagcagtaaaaattgctttgtttgaattattccacagctggtataaagcaaattacagcatggctgagaagttagactggggccgaggaatgggctgtgactttgtcaggaagagctgtaaattctggattgatcagcagagacaaaagtaagaatgcatttcctcacagtgtcactgattacacagttcctttctgactttattctttatcctgagcctaaaatgctattttcaaaatgtagtctgagcagttcaattttaaaatatatagaaaaccatctatagatggttggtaataatatagtgagaagttagctgtaagtagtttttaatcatatactaaaggaatccacagtgaagggcccacagccatgaacatttctattcagcttattagaactcataaatatatatattttacaaaccttttgtttcctctgtcatttgtggtgttttcttcagagaatgcacctgtaaacatagatgcaaatattgattcagtatcaaaaaaaaggcacttttgaataggggtttccaaatccagatgcatattataatcacctagcaagcttttaaaaaatacagagtaagtttgatatctatctatatatcatctatacagatacatatcatacatagtaagtttgacattatctatatatcatctatacagatacatatcatacgtagtaagtttgacatctatctatatatcatctatacagatacatatcatacgtagtaagtttgacatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgacatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgccatctatctatatatcatctatacagatacatatcatacgtagtaagtttgacatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgccatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacgtagtaagtttgacatctatctatatatcatctatacagatacatatcatacatgtatatatacagttgttctttaaccatggaggattgcttccaggacccccctggataacaaaatccatagatgcttatgtaaaagtttcttatataaaatggaatagtatttgcatataacctatgtatatcctcctgtatactttaaattacttctgggttatttataatacataatacaatataaatgctatggaaatagttgttatactatattgtttagggaaaaatgacaaagaagaaaagtgcccatgttcagtacagatgcaaccatcattttttccctgaatttttcttttctttttctttttcttttttttttttttgagacagagtctcactctgttgcccaggctggagtgcagtggcgcagtctcagctcactgcaacctctacctactaggttcaagcaattctcatgcctcagcctcctgaatagctgtgattataggcgtgcgccaccactcccggctaattttgtaattttaatagagatgggatttttccttgttggccaggctggctcacacctgtaatcccagcactttgggaggccgaggcgggtgggtcacttgaggtcaggagttcaagaccagcctggccaacatagtgaaaccccatctctactaaaaatataaaaattagccaggcgtggtggtgggcgcctgtaaccctagctactcaggaggctgaggcaaggaaacagcttgaatccaggaggcaggggttgcagtgagccaagatcgcaccactgtattccagcctgggtgacagagtgaggctctgtctcaaaaaagagaaagcaacagcaacaacaaaaatgttacatgaatgaattcatattgtatgtgaacttttgagcgtggctttttttactcagcataattctctggaaattcatccaggttgttgtatgtatcaataatttcacttttcatggctggttaatattccgcagtatgatacaccacagtttgtttaaacattcacactttgaaggacatctggattgtttccagttttgggctattatgaatgaagttgctgtgaacatttatgtacaggtttgtgtgtgaacatatatctttatttctccagaaaaagtgccaggaatgcagttactggctcattaagtaattacaggtttagttttgtaagaaaatgccaaactttttaattcctgacagtgacgtgtaagtgatatagtttctccacatctttgccagcatttggcgttgtcacaattttttgtttaatcgattctgataggagcgtagtgatattttattttggttttaatttgtgtttccctaacggctaatgatgttgaacctcttttcatgtgcttactcactgataatatatcctctttggcaaattgtctctttgtctttttttttttctgagatggagttttgctccgtcacccaggctggagtgcagtggcgcgatcttggctcactgtaacctctgcctcccaggttcaagcaattcttttgcctcagcctccagagtagctgggactacaggcacgtaccactatgtctggctaatttttgaatttttagtagagatggggttttaccatgttggccaggctggtctcgaactcctgacctcgtgatccacctgcctcagcctcccaaagtgctgggattataggcgtgagccactcttaagccaattttttaattggattgttttttactgttgagttttgagagttcttcatgtattttgggtattttgggtagtagtagtcctttgtcagatatgtggtttgcaaatattttctcccagtacatagcttgtctttttgtccttttaacaggggcttttgtagggcaaatgtttttagttttgacggagtccagaatatcagtttgtcctcttactgtgtctttgatgtcaagtctaagaagtgtttgccaagctctagatcttgaaagttttcttatgtttttttcaaaagttttgtagtttacactttacatttaagtccatgattcatttgagttaagttttgtataaggtgggagacttagatcaaggtttgtttctttgtgtacagataggcaatggctttagcaccatttgttgaaaaggctatctttccttcatggaattgcttttgtgcctttggcagaaaccatcagttgggtgtatttgtggtgatctgtttctatctgtttctgtgttttccgttctgttctagtgatccatgtgtccatgccttcaccaataacacacagtccttaattactgtaattatttaataagtcttgaaattgggtagactgattctttccactattttaaaattgttctggctgttttggttcctttgcatttccatctacgttttacaattatctcgtctgtatctgccaaaagacttgcagggattttgctaggagctgcattaaccctgtgtgtcagtttgaggagaattgacatttttactgtgttgagttttccaatccataaacatgggagaaaacattcagtctttcattattaaatataatgttagctgcagattttttatacatgttctttatcaagttgagaaagtagctgtctattcctgtgtttctgagagctttaatcatgaatggatattgccttctgtcaaatgctctttctactttagttgctatgcataatcaagtgatttttttcgcctgttaatatggtggacttcattggttgattttcaaatattaaatcacccttgcattcctggagtaaaccccacttggtgatggcttataattatttctgtatgttgctgaattctatgtactattattttgttgtggatttttgtttctatatttgtgacgaatatagatctggagttttctcttttttccccaattattttacctttaattaatcagtatggctctcagaacaattatattatgtcagttaaacttgatctttttcaaatctgacacattttgaaaaacaggtatatccttccagtaagagagatttaaaaaataatagtaagaagaaaatttatgaaatacataataattattactaaatgagcaaataatgggctctcctgtcatacttaatattgacttgatttaaattattatttatggccagacatggtggcttacacttgtaatcctagcactttgggaggctgaggcaggctgattgcttgagcccaggagttcaagactagcctggacaacatggcgaaagcccatctctacaacaaaatacaaaaatgaggtgggcatggtggcccatgcctgtagtcccagctactcagaaggctgaagcaggaggatcacttgagcccagaagctcaaggctgcagtgagctatgactgcaccactgcactccatcctgggcatctctacataaataaatgatttatataatactctgaagaataaatcccagtatatgatgaggtgtttatcatgctttatttttattttgattcagttcaaaatatttttctcttttaattcaaaactcttgtgtcactttgagttcaaaatatttttaactttctcttgagatttcttctttgaccactgtataatttagaagtgctttgtttaatttccagctattttgagatgttccagctatctttctgttactgatttctagtttaattccattgttgcaagagagcagaacatggtatgatttctcttttacatttgttaaggtgtgtttcatggcccagaatgtggtctgtcttggtgaatgcaccatgtaagcttgaaaaaaatctgttgtctgctgtttttggttgaagtagtctgtagagtctgctatatccagtttgttaatggtgctgttgaactcaactgtgtccttactgattttctgcctgctgcatctgtccatttctgagaaatggatattcaaatctgcagtgataataatggattcatctatttcatcttgcagttctatccattttgacttacatattttgacactttatagttaggtgcacacatgtttaggattgttatattttcatagagtactgattcctttatcattttgtaattcctctctttatctctgatcattttctttgaaaagaaaaaagttcttttttgtaccatctttgtctagtttctgtatcagagtaatactagctttataaaatgaactaggaagtttttcctcctcttctatttttctggaagagattgtataaaattggtgttaattcttctctaagtgtttggtagcattctccagtgaaacatctgggcctggagatttctcttttggaagtcttaaaattgtgaattattgtgaattaaacttctttagtagttacagggctattcttatcatctgtttcatagtgcatgaattgtggtaacatgttttttaaggaattggttcattttgtctaagttatcaagtttatgtgtatagggttttttgtagtattccattattattcttttgacatctgtagggtctgttttaatttgtaatttttgttggtacatactaggtgtatatattaatggggtaaatgagatattttgatataggcatacactgtgaaataatctcatcatggaggatgggatatccatcctatggggtctgttgtgatatctcttttcagtcctgatattggtaattttgcatgttctctttatctttttctagaggtttgccaattttactgatcttaaagaaccagctttttgtattgttgatgtcttctattgtttttttgttttcaaattcattgatttctgctccctgctatatctttcccactgcttgtttttggtttatttatttaattattatgatgatgattattttttgagatggagtctcactctgtcgcccaggctggagtgcagtggcacagtcttggctcactgcagcctccgcctcccgggttcaaacaattctcccgactcagcctcccaagtagctgggactacaggtgcacaccaccacaccccgctaattttgtattttttagtagggatttcaccatgttggccaggctggtcttgaactcctgacctcaagtgatctgcatgccttggcctcccaaagtgctgggatgacaggtgtgagtcaccacgcccagcgttttctgttttgttttatttttaaagacaaggtctgttgcccaggcttgagtacaatgggtgcgatcatgaggctcactgcagccttgacctcctgggctcaagcaaacctttctcctcagcctttcaagtagctgggactacaggcacacacccccacacccagctaaatttttgtatttttgtagagacagggtttcactgtattgctcaggctagtcttgaactcctgggctctagcaatcggcccacctcggcctcccaaagtgctgggattatagtcgtgagccactgtgcctggcctatttttctcttcttaatcttgatttttgagattattgatttgagatatttcctgtttctaatgtagctatttgttgctataaattttcctcttagcatttctttagctttatctcacaaattccaatatgttatatttttattttcattcagttcaatgtatttttaaaaatttttctttgagattcttctttgacccatcgattatttagaagtgtgttgtttagtatacaaatatttggaaatttttctgttattttttgttgttgaattgtatttggagaatatatgctgtatgatttgagttcttttaaatttgttcaggtttgttttatggcccaagatatggtcttatcttgatataagttttttatttttttttattattatactttaagttttagggtacatgtgcacaacgtgcaggtttgttacatatgtatacatgtgccatgttggtgtgctgcacccattaacttgtcatttagtattaggtatatctcctaatgctatccctcctcactccccccaccccacaacaggtcctggtgtgtgatgttccccttcctgtgtccatgtgttctcattgttcaattcccacctatgagtgagaacatgcggtgtttgtttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgatcgccattctaactggtgtgagatggtacaccaaaagcaatggcaacaaaagccaaaattgacaaatgggatctaattaaactaaagagcttctgcacagaaaaagaaactaccatcagagtgaacaggcaacctacagaatgggagaaaatttttgcaatctactcatctgacaaagggctaatatcgagaatctacaatgaactcaaacaaatttacaagaaaaaaacaaacaaccccatcaaaaagtgttttttttattttttaaatttttttgagacggagtttcactctgccacccaggctggagtgcagtggtgcaatctcggctcactgcagcctctggtgccgagttcaagctcttctcctgccccagccttccaggtagctgggactacaggcgcccaccaccatgcccggctaatttttttatttgtagtagagacggggtttcattctgttgaccaggctggtcttgaactgctgacctcagctgatctgcccgccctggcttcccaatgtgttgggattacaggcgggagccaccgtgtacattcggacgctgggtgaagcgttgcacaaatgtcagttaagtcctgttggttgatgatgttgggttcttctatatccttgctaatttcctgcctagttggtctatcagttgttgagagaattcaccaccatatcagtctttgagtcctgaagtccctaactagtctgacttctctccacccttcagagccccctaactagtctgacttctctgtaccgttcagagcctcctaacgagtctgacttctctccacccttcagagtcccctaactagtctgacttctctccacccttcagagtcccctaactagtctgacttctctgtacccttcagagtcccctaactagtctgccttctctgtacccttcagagccccctaactagtctgacttctctgtacctttcagagcctcctaactagtctgacttctctgtacccttcagagccccctaactagtctgacttctctccacccttcagagtcccctaactagtctgacttctctgtacccttcagagtcccctaactagtctgacttctctgtacccttcagagtcccctaactagtctgacttctctgtacccttcagagccccctaactagtctgacttctctgtacccttcagagtcccctaactagtctgacttctctgtacccttcagagtcccctaactagtctgacttctctgtacccttcagagccccctaactagtctgacttctctccacccttcagagccccctaactagtctgacttctctccacccctcagagccccctaactagtctgacttctctccaccctttagagccccctaactagtctgacttctctgtacccttcagagccccttaactagtctgacttctctgtacccttcagagtcccctaactagtctgacttctctgtacccttcagagccccctaactagtctgacttctctccacccttcagagccccccaactagtctgacttctctccacccctcagagccccctaactagtctgacttctctccaccctttagagccccctaactagtctgacttctctccacccttcagagccccctaactagtctgacttctctccacccatcagagccccctaactagtctgacttctctccacccttcagagcctcctaactagtctgacttctctgtacccttcaaagcctcctaactagtctgacttctctgtacccttcagagccccttaactagtctgacttctctgtacccttcagagcctcctaactagtctgacttctctccacccttcagagccccctaactagtctgacttctctccacccttcagagccccctaactagtctgacttctctccacccttcagagtcccctaactagtctgacttctctccacccttcagagccccctaactagtctgacttctctccacccttcagagcctcctaactagtcggacttctctgtacccttcagagccccttaactagtctgacttctctgtacccttcagagccccctaactagtctgacttctctgtacccttcagagccccctaactagtctgacttctctccacccctcagagccccctaactagtctgacttctctccaccctttagagccccctaactagtctgacttctctccaccctttagagccctctaactagtctgacttctctgtacccttcagagcctcctaactagtctgacttctctgtacccttcagagtcccctaactagtctgacttctctgtacccttcagagtcccctaactagtctgacttctctgtacccttcagagcctcctaactagtctgacttctctgtacccttcagagccccttaactagtctgacttctctgtatccttcagagccccctaactagtctgacttctctccacccttcagagtcccctaactagtctgacttctctccacccttcagagccccctaactagtctgacttctctccacccatcagagccccctaactagtctaacttctctgtatccttcagagccccctaactagtctgacttctctccacccttcagagccccctaactagtctgacttctctccacccttcagagccccctaactagtctgacttctctccacccttcagagccccctaactagtctgacttctctccacccatcagagccccctaactagtctaacttctctgtatccttcagagccccctaactagtctgacttctctccacccttcagagccccctaactagtctgacttctctccacccttcagagtccccttaactagtctgacttctctgtatccttcagagccccctaactagtctgacttctctccactcttcagagccccctaactagtctgacttctctccacccttcagagccccctaactagtctgacttctctccaccgttcagagcccgctaactagtctgacttctctccacccttcagagccccctaactagtctgacttctctccacccatcagagccccctacctagtctgacttctctccacccatcagagccccctaagtagtctgacttctctccacccttcagagccccctaactagtctgacttctctccaccgttcagagcccgctaactagtctgacttctctccacccttcagagccccctaactagtctgacttctctccacccttcagagcctcctaactagtctgacttctctgtacccttcagagtcccctaactagtctgacttctctgtacctttcagagcctcctaactagtctgacttctctccacccttcagagccccctaactagtctgacttctctgtacctttcagagcctcctaactagtctgacttctctccacccttcagagccccctaactagtctgacttctctccacccttcagagccccctaactagtctgacttctctccacccttcagagccccctaactagtctgacttctctccacccttcagagccccctaactagtctgacttctctccacccttcagagccccctaactagtctgacttctctccacccttcagagtcccctaactagtctgacttctctccacccttcagagtcccctaactagtctgacttctctccacccctcagagccccctaagtagtttgacttctctccactcttcagagccccctaactagtctgacttctctccacccttcagagccccctaactagtctgacttctctccacccttcagagccccctaactagtctgacttctctccacccttcagagccccctaactagtctgacttccctccacccttcagagtcccctaactagtctgacttctctgtacccttcagagtcccctaactagtctgacttctctccacccttcagagtcttcttttgtttctttaatttacagtgtctgggtttttagttgtacttagaagggggaatagagaaaagcacatctagtccatcttccaggaattagaagtggtactgatatttctattgttatatttaaaaaaaaattcccctggtgggccgggtgtggtgtggtggctcatacctgtaatcccagcagtttgggaagagggaagatggcttgagcccaggagtttgagaccagactgggcaacatgaccccatctctacaaagtaaaaaaattaggctggcatggtggcgtggccctgtagtcccagctacttggaggctgtggtgagaggatcccttgagcccaggaggtcacagctgtggtgagctgtgagcatgccactgcactccagtgtgggtgacagcaagaccctgttgcaaaaacaaaaaaaaaaaaaaaaaaaggaaaagaaaatactattctcatcttttctcacctaggttaggtcataaagcaatttaaatcacttgtagtttctactaaggagtctgacctctgagttgtaaccctaatgtgaagataataggcagtagccggaagcaccggcaaccactctgggtgtccccagcttgttacccctgcactacaggttgacctgccagttctcaaattttgctgcttatgaaaatcgtctacagaactggaaaaactctccataccccagttactaattaagtcatgactgtgctgagagccgggcactagcattgtgtgagtttgttttaataaattcccaagtgattttatgtgtaatggagtttgggaaccactgttccggtgtgtcaaaggaagtatgtaactcacactgcagctgcaagagcttagggaggtttttgtttgttcacttttctgttaacagttgcaactctgtttattccccttttggtcccaattataacatcacctaagaccagaaacagaagggacttctacttctttattcttaaaaactaaaactgtgggtcccctgaattctctcctgtcctttgattcttaagccactgtcagcaaggtttttttttgaagtccaaatagtaaatattttaggttttgagggttattacagtctctgtcacaactacttacctctacttttatacagcaagaggcaaaacaaatgggcatggccatgttcctgtcatcttccccatctctacagaaagtaaatgagcatggtggcacatgcttgtagtcccacttgcttgggaggctgaggtgggaggattgcttgagccgagaagatcaaggctgcagtgagcaatggttgtgccactgcactccagcctgggcaacgaaaccctgtctcaaaaacaaaaaatcgacaaggaaaaaaaaaacaggttgtggtcaggatttgacccaagagttgagtttgctgacccctgtcacagtcattcaaatgtcccacttgtgaggcattgaaattcagaatcatttacaggatagaagccatcttctgacatcacagacccagtctgcctgtatgtatgttagagattccagtgtggctgttctcaagcacttctgggcttcgtcatttgtgactcttctccattgttgggaaaccagggtgagaagggattggttgagtgagcgtaggcagagccatacttctttgaatcacttgaatctacacctacttaaagtaaggttctttctatgttcgaagcaactaaaactgataaatcgcccaactcctctgcctagctcatttggtgttaatattggctctagagctatactgtctaatatggtaccattagccacatgtagttaaacttatatttaaattaaagttaaataccatttaaaatttagttcctcagggccaggcatggtggcccatgaccgtaatcccagcactttgggaggcagaggtgggcagatcacgaggtccagagattgagaccatcctggccaagatgatgaaacctggtctctactaaaaatacaaaaattagctgggtgtagtgggacacacctgtagtccgagctacttgggaggctgagggaggagaattgcttgaacccgggaggtggagcttgcagtgagccgagatcgcactactgcactccagcctggcgacagagcaagactctgtctcaaaataaataaataaataagttcctcagttaactagccacctttgaagtgacatacatgattagtggctaccatattgggcagcacagatgtacaccttttcccgctctcttgacagtgcttctctggaatttgtaagccatgaatcttagacagctctaactttggaatgtttaaaatcactaagttttaacttcttttttcctctttattcatttagccaaaactcattttatataatttaaagtaaatataatatgccttttggttttagacaaaaaacagaaatgactttcatggtatcaagaaagtaactgattaacaactattggaacatgagcttccatattcattggaagctttatcatgggaagttaaaatattgccttatatgaagattttacgaaaatggtataaacagcggaaatcacatttattgagtagcctgcatgtgccaggcactgagtgctttgcggttgaagctcaggaaagttaagtaaattccacagaagtgtggctggtgctggtgtttgaacccagacctgtgtgacgacttcaaagcctttgctttcctgttaggctgtgctgcttcccatttgctgaagactgtggcaagtattttacgtgtttcatcttaggaagctgtaactccctaaagatgtatgctgagacaccatgttcatttaaataagacaagtcatcaattttccttaaaataagaaatatttaatacaggcttttttttccttaagaaatatgtggaagaagaggaaaattgtcaataattcgattacaatttgttagaccagtattaataggatttctattatttaggaatactgagattttatctatgaagctgctattgtgatattaatataatttttatatcgtcaactgtcagtttgatgactgctaagaattacaggtttgtttgaaggttatttttgcaagacagtgcaacagattctgatatcttttgataatttacatgcccttttttcaaattatactttcaagattacatttaatggaacagaacaagttgataacaattaggaatattcacacaatctttattttgcacaggaaaataagattgtctggtgaaggtggtcagttaaacaaactgtcagattattgagcagagaaaattccactctttgtagctgcagggcagaggggacattgcctccatctctttccaagaatcccatttgttaattatgaaggtttgtatttttaggccaggatctggaattccatttgttggctgtataatggacttgcagtattttctttaaagtttgataccatggtacttctctttgtttgcaggagacagatgctgagcccttactgtgacacgctcagaagtaacccactgcagctaacttgcagacaggaccagagagcagttgccgtgtgtaatttgcagaagttccctaagcctttaccacaggaataccaggtagaacagggctggggcacagtttcaggaatcagcttttcaaaagtagtctccattttaactaaaagagtaaattctcttaagattcttaatttataaggccttgtttgttttctgtaagttagaaaaaaatggaataatgcttccatttctttaaaactaatgtcctaattgatagcacttagttaaaatctagcagtgtcttataataatggcaagaataatttgaatatttgatctgtttttacctgtttatgttttctaattgtttccaaagccttgctatttaaattcctctaatttacacagaaaaagaaatctttaaagaaaataacttaagtactccaatccagttaattagaagacttggaaaccctgctttggaaaagatttgattcatgggatctgaaagattaaggaaatggtcccacatatcttgtctggatctctgatttgacctttatgtttctttttatcttttatctttttttccgagaccgagtctcactctgtcgcccaggctggagtgcagtggtgagatctcagctcactgcagcctccccttaccagattcaagcgattcttgtgcctcagcctcccgagtagctgggtttacagctgcaagccaccatgcctggctaattttcatatttttagtagagttggggtttcgccatgttgcccaagctggtcttgaactcctggcctcaagtgatccatctgcctcggcctcccaaagcgctgggattacaggtgtgagccaacatgtctggctactttttgtatttctaatagagacagggcttcaccatgttggccaggctggtctcaaactcctgacctcatgtgatctgcccgcctcagcctcccaaagtgttgggattacaggcgtgagccaccatatgcctggccatgacctttaagtttcttgttgccaaagctatctttaaaaagcctcaactttacctgccatttataaaggaaccttttgtcagaaatgatgtctcagaagctaatttaaaataaagctgctgaattttaagcttcctacacatatttgtgagctcactgaatgcttcagataccataaaatagtaactatattcataggcatagtgatataactcaataagttggtggaaaacgtgacatctttaaaaatttatctggtgcatccaggggtgtgaaaacacatacaattattttatttttatttatttatttttggagatggagtcttgctgtgtcaccaggctggagtgcagtggtgcaatctcggctcacttcaacctctgcctcccaggttcaaactattctcctgccgcagcttctcaagtagctgggactacaggtgtgcgccaccacacccagctaatttttgtattttttttttttttttttttttttttttttttagtagagacggggtttcactatatgttggccgggctggtcttgaactcctgacctcaggtgatccgcccacctcagcctcccaaagtgctgggattacaggcgtgatccaccatgcccggccataaaattaattttaaaaaaaaggaacaataaaatttatctggtgccttgtacctttggtattcaaagtatattatatatatgatctcatttattttctcagattttaattttttcaagtttgtcaaaacaacgtataaactgcctcctaaaaactcttgaaaaatttatttaaaatgttgtaactttatgcattagttctgtgttttgtcagctcttaaaacttctttttgctcagtgtaattaaaactacatgctgttaaaacattagtctaatttaacattatgatatataacttaagactcatttacttaccttgcttatttgtaaaactgtagcaacctttaactactcctctggtggtttattactgtgttctttatttggtgccattgatgaagaaaggtacattagtatcttgtgttatgtggcattaaagggttgcgagaaattgcctgtgcacttcctcaattttatacagaatgtttcttactttcttgtcttcccaatattttttctgcagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccaggttagtcggctagtgaaatgaagtattatatacatattaaaattatgtattagcaatatagaatcgtggttaagggcacagaccctagagcaggactgtctgaatttgctttatagttcagctgctatccatatgtaagaagtgacttaacttttccctgcctgtttcttcatctgtacgatggaggcaatacttagagagttgtgagaattaaatgaattaatgtagtaagtgcttacaattgtgcctgacccatcgaagggattattcgcgtatgcatgcacacacgctatattttggtcataccttctagctgcacggcactttccatttgcaaagcactttcattcttaacattttattcttctgaaaacatgatgagaaacataaggaagatattactgtatttcccagataggcggatagatactaagtgatatagttaaatttgtgtcagtgcaagatcctccaatgccatcctctttttattaaaatacctcagataagctgctttttcctcttgtggggaatgtgcattttatgtaagatagaagcaacatgtcactcttcagatagcaaaacaatgttcttgtctcatggccagtaagatataccaccatattatttgtttcttcttaatacatataaatgaacaagatatcaaaggaataaacagtatggcaattgggtattctgcaataatagttacagctcatactaattacctttgtaaacagaaatgttctcacatctgatgtaagaaagagcagtaagtagtttttctctctgtgttcatcagaagttttaacctagtctccaaacccccaccccattccatactttattacagactaaggcatttacattctaaatttttgtattcttaccttttactcttaaacttggcagatgtaactggattcctgcagtcatttttccccatcattcatctattcaataaatgtcctggccaggcgcagtggctcacgcctgtaatcgcagcactttgggaggccaaggcaggtgaattgcttgagctcagaagtttgaggccagctgagcaacatggtgaaaccctgtctgtatcaaaaatccaaaaaattagccaggtgtgatggtgcacacctgtggtcccagctatggaggaggacgaagccagaggattgcttgagcagcccaggaggcggagtttgcagtgagtcgagatcatgcccctgcactccagcctgggcaacacagtgagaccccatgtcacataaaaataataaataaataaatatcctaacaacttataaccactcagcagttccatattaaagcaaaagaaatgcacagatctgtcagttatggatttgccagagatgtactatcacatgttattgttttagagctggagctggcaaacgttttttgttaacggggaaaattataaatatctggggctttgtgggtcataaggtctctagctttctgattcagctcagccgttaccgtctgaaagcagttacagacagtatgtacgtgaatgaatgtgccaggatttggcctgagggttgcagtttgctgaattctgttttattattattattattattatttttagagacaaggtctcactctgtcacccaagttggagtgcagtggcaccatcatagctcactgtaacctgtaactcctgggctcaagtgattctcctgcctcagactccccagagccaggactacaggcatgcacctccacacctgactaatttttaaaaatttttgtagagatgaggcttgctatgttacccagactggcctcaaactcctggcctcaagcggtccttcctccttggcctcccaaagtgttgaaattataggcttgagccaccacatccagccctgaaccccattttagacactgatcactatagttttgaaagactctgatactcaaaagaagtaaagaattctgttttattctaatttgcattttttagcttatataattcagatttatcaaaactggcataaaacacttatctttataatattttaaaatgggctaattgaactctctacttccccaaagacaacttattgtaaagagtctaaagagagcaaattactgctcgggtttaagagctttgtccctttgtccattagaggcctttcattcctctgcaggtttgtgcatactgtgagattagatcagcatcttactaggttggtggaagagtaattgtggttttgccgttaaagtaatgcgaaaaccgcaattacttctgcaccagcctaatatttgtggacttccaggaggtggcacaagttgaagatataagaaagttttcaaatgttgcaacaccccccaaaagtctgcattatataaatcacttggcctcatcctatcatgagtaatttggaggtgcctcctatttagaccaccagtgaagatgattttatcttggtgtctagtgatctaacgattcttagtgctagttcttctatatatttaacctagaaaacgttgggcccagttttattcccttgtgtctgatgcagtaattttctcccattaattcctttattaagaacctagtgtgagtttggaaccctgtggatcctaattttttttttttttttttttgagacggagtctctctctgtcgcccaggctggagtgcagtggtacaatctcggctcactgcaagctccgcctcccgggttcacgccattctcctgcctcagcctcccgagtagctgggactacaggcgcccgccaccgcgcccggctaattttttgtgtttttaatagagacggggtttcaccacgttagccaggatggtctccatcttctgacctcgtgatctgcccacctcagcctcacaaaaccctgggattacaggcgtgagccaccgtgcccagcctaccctaattttttaaatttaaaatttccatgaaacatgtctgatttttaaagcaacttttaatcataaaaatggaatggttcagtttcttgttctttgagccaaaagtcaatttttaaggagacttttcttctttgcctcagaaatttttaagaactatggcgctgaaaagtatggacctcattccgtttgtctaattcagaaatcagcattcgttatggagaagtgtgagaggaagctgagttacccagactggggaagcggatgctatcaggtaagcttatgtttgttattagttgtgccaaatattatgtgattttatctcttttatggttttgtattttaaattatattttcatattttatgtcattaatttactgatcaatactgtatcttgtttatgtaaatattagtttggatgcttatgttttatgaaaatattgtcatttctttagaaaaagtgcctcttaaaaatatatatgtaattactgtaatgttacttctgggcatatattctgaggaagtaatggtaaataggtaattttgttcttgagcaaatattactttgtaatggaaaacatgtcaattttatttcaaaaggtctgaggacctcatgggttataagaattagtaaatcaggctggacgtggtggctcacgcctgtaatcccagcactttgggaggctgagccaggaggattgcttgagcccaggattcgagaccatcctaggcaacaaagcgagaccctgtctccaaaaaataaaggaaaaagaataaatcagttgctgattaataatagagtgttttttcctttgtaattagaaatccaaaaagggcaaactacaattttttttcctttttctttttcttttttttgagacaaggtcttgctctgtcagctaggctggagtgctgctgcagtcacggctcattatatcctctacctcctgggttcaagcgaccttcccacctcagcctcctgaggagctgggactacagtgtgcaccacacacccgactaagtgtttgattttttgtagagaagaggtctcactatgttgcccaggctagattagaacttcggggcccaagcaatcctcttgccttggcctcccaaagtactgggattatagatggcggccaccatgcctcgcctactatttccttaattatcttatttgcacatctgatattatatgacatcaccttattaaggacttataaagatgtagccattctgtgacttaggagcatccaatggaatgaatcttctgcaccctacaaatggatgtcagggaggacagcgtaagcctgagaaatgcagaatcagcattcctgtgccatttcagctgcaagagctaaacggacctttagaactggaaatttaactcttatcattagttacttatcaaattaacgttttttttggtaactgcttttcttcttttctgtttttttttgagacagggttttgctctgtcacccaggctagagacaatggtgcgatcacgctcactgcagccacgaactcccaggctcaggcgattctcccacctcagccatctgagaagctgggactacaggtgcacaccaccacacctggctgatttttcttattttttgtagagacaggcttttgccatgctactcaggctggtcttgaactcctgggttcatgtgattcacctgcctcagcctcccaaagtgctgggactacagacatgagccactttgcctgacctggtaatagcactatcaagatatattttacataccatacaatttatgtaaaattaactttttttttcatttttcctcttttgagacagggtcttactctgtcacccaggctggagtgcagtggtgcgatctcagctctctgcaacctccacctcccggttccagagattcttgtgcctcagcctcctgcacagctggaatcacaggcatgcgccaccatacccagctaatttttgtatttttagtacaaaaattgaccaggctggtctcaaactcctggcctaaactgatcctcctgcctcagcctcccaaagtgctgggattataagcatgagccaccagtcctggccgaatatttcttttctttctgtaacaagatattctaagctcactttgttctttgtctacccctgacgtggaattaaccgtttctccagaggcccctagttacttttaatggagtatggtgtttagagactaagatctgggcggtaattatactgttgattgcttttggtggagtgtttggtgttagagactaagatctgggcgctaattatactgttcattgcttttagtggagtgtggtgttagagactaagatctgggtggtaattatactgttgattgtcattgataataacatttgggaattgggaataccagctcatcaggccctcttagtaaggtaggaaatgtatgtatatgtatcagtacactctcctgtgagtgcgtgtgtgtgtgtgtaagtaatcatgagtttgcatcagtaaggttggtttgattccatcggttggagaccttgtctgataccaaagcatttattttagttttccaccttttcacatatgtacttccttcaccaacagtgagaagtccagctgctgtcatctcagcatgtttactcatctgatctatccacatcccgtccactttctcccactcccattaccctcgtcacccggccaactctgcgtgacctcccggtcacacacctcccccacccctccaaacagatcacctaccttgcctcacttaacggctttagacgtaattgcttttgaggaaggggaaaggagaaagggagggatcactgggcttttttttcttaaaattgtggcaaaatatatataacataaacatttccattttaactgtttttacgtgtatagttaagtggcactaaatacattcacgttgtcatgcacattgccaccgagcgtctcagaaactctgtactcactaaacaatccctccctcttcctcctcccccagccctgacagcctctattctacgtcctctctctgtggatttgcctaatctagatagtccttataagtagaatcataccatgtttgtccttttgtacctgactccttttacttagcgtggcattctcagggttcatccacattgtgccatgtatcagaacagtattccttacggtgttcctttatgtctcaataacactccattgtatggatctgtcacgttttgaatcagttgatggacacttaggtcgtttgtgtccacctcttggctattggagtcttgctgcagcgaacactggcttccgcgtatctgtctgagtccctattttcagtctactcagcagtagaattgctgtatcatatggcaattctatgtttagcttttttaggaactaccaaactaggttttttgttgttgttgttgaggggtttttggtgttattttgaggtttcttttttattattattaatagactttattttttagagcaattttaggttcacaacaaatttaagtggaaggtacagagagttcccatatacccctgctccacacactcgtggccttccgcaccgtcagcatcctgtaccacagaggcatttttggtacaatcgatgaacccacatcatcatccaaagtccatgttcacattagggttcactctgggtgttttcaatgaaccgacatcatcatccgaagtccatgttcacattagggttcactctgggtgtttcgatgaaccgacatcatcatccgaagtccatgttcacattagggttcactctgggtgttctacattctgtgggctttgacacctgtaggatattcgtccataagataaatgagttgttgaaatggactttgttataagttaaagattggctatctgtggctaaataattgctgagactaacataaataagaataaatgaaataaaaagtgggatgaaatacttcaggtgaaagttcaaagggaaactgtattatctctgtacaaaagagacctttaagcgtgtgttttcatgtcaaccctttgtgttcttaacatgtttttccctgatgaaactgagatcatggaccttatcatatcaccttttgtgctgatggcaccttttaatataaatttttaagtaatttatatattgattaaataagtcagcaattcacatggtgaaaaattcaaaagatgcaaaagaatgtacagggtacaggaaaagcctttcccagccccgtcttttagtcactcacttctcccttcggagggaagtaatattaccagtttcttgcatccttctaaagataaactctgtgcaggcacaaatttatatttttgtttcattttttacaccaatagtatcaagttacacatactgttctgtggtgtgtattaaagagtcgttcttagtatcatcttacatcattccagccccatgtctgaactggctgtggacgtctcaagtacatttggttgtactttgatcattctgaattcagttcctccaaaatccagtttaggagccctctctcaacaacgctgcatttcggctgtgttgcttccagcactggtcccagtctctctaattagaaaccagaatgatcattttctactctctgttctataaagacggtcaatacagactaagtctttagattactctcctattgaaatctcttatatctattttattttaggtttaccttcatagttcaagccattatcacttcacagtttcctaactaatttccctcctctcatcttacttccatgaccacgttgatccttttaaaattttagttttgatcaaacttttacatgcaaatagtttgaaacaaatttgttgtctgcttccaaaaaactacagcctcaggccaggcgctgtgactcatgcctgtaatcccagcactttggttggctgaggctaacacttgaggtcaggagttcgagatcagcccaggcaacatggtgaaaccctgtctctactaaaaatacaaaaattagccgggcatggtggccgcctgcctgtgatcccagatattcaggtggctgaggcatgagaatcgcttgaacctgggagatggaggttgcagtgagccaagatcgcaccactgcactccagcccgggcaatggagtgagactacatgtaaaaacaaacaaacaaacagaaaaacacacaaaaaactagagcctctgttattacttccctaatgtttattacttcttcccagagtcttcactttcaattcttagttgttgttttgttgggggtggaggagtcaggggagacttactatttgctttcttatttttttttattattattacttttttgagatagattcttgttctgtctcccaggctggagtgcaggtggcatgatccctcggctcactgcaacctccgcttcccaggttcaagtgattctcctgcctcagcctcccaagtagctgggattataggcgcccgccaccatgcctagctgtttttttttatttttagtagagacagggtttcaccatgttggccaggctggtctcaaaatcctgacctcaagtgatctgcctgcctgggcctcccaaagtgctgggattacaggcgtgagccactgcacctggcctgcttttttatttttaaaaagcttatattattctttcataaggtttgaatttcaaatgttagctgttgactttggaaaataagaatttagttggttcgcctcgtcctcttgctgtgttcacttcctctttccccatcgtacacttcttgtttcccatcctcccagtggtgattatggataaatacgtattcactgtttacattaccaggactatgcagacgtggcgcctggtagcatgcaatcattacttccccgttctccccagtatttcgttttctctggatttaagaccttgtttttttgcaattagttttctttgtatttagcactaattcaattctaagctcttctcccagttgggctcatctcctttcagtagaaccagatacctgaggtattctatccatttcatcttgaggaaatctcttctggacatttctggcctgtgctaatctcgactatataatccttatgttggcagcacagctggcatcttgggatctcgagtcaggatcatcctggaggtccctctggtccctctgtctctctcatattggatcccctccttcatggattttgtgtcatattcttttttggattttttttattttaatggaacatatcttctagtggagatttgaggagtatgtgacggagaacaatgttgagacttgcatgtctgaaagcatcactgttccactgtgacgcctgctgacagcgtgggaaggcgggacttcatctctgccctcagggtcttcagctagtttccaccgtgatgtgacgcctgctgacagcgtgggaaggcgggacctcacctctgccctcagggtcctcagctagtttccaccgtgacgcctgctgacagcgtgggaaggcgggacctcacctctgccctcagggtcctcagctaggcctgagaatgaaataggcataagcccgatgaacaggaggaaaacatacacatttatttaatctaagttttacatgacacaggagcccacatgagtaaatgaaaactcaaagaagtgtgaaacctatatacttttatactacattgaacaaagggagacagttacagaaaagtaaaatgtatgcggaggctaaaggaagataagaattattttaagaaggtctgtttgtaccaaattctttggctttgactccccatattggtgataaaaatgtttgttttctcctggaaaaggaagggtattattcatgtgggagttgtgtcttctgctttcaggaggaagggggatgtcagaacagtcttgctgggtctgctgtgttgaagtccctttagctggaaacctttgtgccaaaacagcacattttggggtggcgtgttctgccgtccttcaatagcttgggtgggtatagctttatttttgaaaattattttcctaatggatgattgggtgcaggaaaaaaagaaagaaaattattttccatcagaattctgaaagcatttttcctttgtgtgctgactgtcagtgtcattctgagtttcaattgccagaatcttttttctttcttctctggaagctgtaaattcttaattttaacttcgcataccacatcctcatctgccacaagccccagtattccaaaatttaatgggttgattctatttttggtgatcattaacagcctgttcatattcaagaagtgactggagcctggcacagtggctcacacctgtaatcacagcactttgggagcccgagacaggcggatcacttgaggtcaagagtttgaaagcagcctggccaacatgatgaaacccctcatctactaaaaatacaaaaattagcccggtgtggtggtgggcgcctgtaattccagctacacaggaggctgaggcatgagaatcacttgaacccaggaggtggaggttgcagtgagctgagatgacactattgtaccacagcctgggcgacagagtgagactctgactcaaaaaaaaaaaaaaaagaaaagaaaagtgcctggaagccagtttggaagctctgagcacacacatagggcttgttgactgtggtctccctatggggctcctttcttacaaaacctttgatgtccgtccttttgacgggtcagattggtcagagaaactgccagtgacccgcctaagtttatatgctgtcagagttctaggaaggaagtcgattttgaatgctttaacctgtaaacttcgagtccttattttcatgatggcatcccagctctctgctgtacttagttttccccagaacagaaaaactctgttttaccctttccaaaaaataaatctccagtatgctggtgtattagtccattttgcgttgctgtaaaggagtatctgaggctgggtaatttataaagaaaagaggttaattttggcttacagttctgcagactacaggaagcataagtgctgtcatcggcttctggtgacggctcaggaagcttacagtcatggcggaaggcagagtgggggcaggcttatcacatagagcgggaacgagagaggagggagctcccgacctcttgaacaagcagatctctggggaacttattcctgtggggagggcaccaagctattcatgagggatccatccccatgacccagacacctctcactaggccccacatccaacactgggaatcatatttcaacagaagatttggacaaatacccaaactatatcagctgggttcggaacgaactggtccagctggtcgcagtgagggagaggaatgctggcgtctgtctctgaaacagacgtttgtctaatccttttgattgtagctcttacttcttggtaccaggtgtggctgtggcagtcctgagccctcttgtgttctgcagatcagtttcttcctggctcttcctgttgctggattttgatccagctttcctgagtctgttatgtctgctgctacctgtacatctaccctcctgcccacacttaattcccagaattccacaatgagaatacttcaacttcagcaagggagttttcctcttgtcctatcaacactctcatataattctcatctctaagccatgtgcattctgcttcccaacctgtaacatctgcccggcagtagtccaaatcctgtgtacatccttaggatgcaaatgctgtcttccatgaaagtttctaatatttgttcttgtttctaccatttattgactcttaatcataaaatagtctggtactgttcattttttgctttttcttctaatttcaaaatacagttagtattttataaaaaaaattattatttttattatcttttttttttgagatggagtctcactctgtcacccaggctggagtgcagtgatgggatctcagctcactgcaacctcggcctcctgggttcaagtgattcttatgcctcagccactcgagtagcccaccattacgcctggctaatttttgtatttttagtagagacggggtttcaccaggttggccaggctggtctcgaactcctgacctcaggtgatccacctgccttggtgtcccacagtgctgggattacaggcatgagccgctgtgcccggctgaaaaaaatttttatatcctactcctctttcctcaattgaaactgctagagggcaggcactgtattgtgtacttttttagtgtccttttcagcgccaagcacggcgcttgatcaagtctcgctttaaagaataatgatgttgcactgtagctgtggtgatgcttacttgatgtggatcacggagtgacagagaagaggtcacacttcattgtttgtttttgtgatatcttaaaacaaatgttcaaaagagtgatatatttcaacttaactgatgatagagttatttcaaaatgacttcaaatatacttttgaaattatctttggtagtttaatagtcacctaaggaaatcaatcttagtaattttgtgtcacacgttgtcttaaccaggttagtcaactacctttgctggacttgcttctgggcaaccttgggctatttccaaaaattatatctacttgctacttaaaaatttgctaccatcagacaggttcagaagcatgcactgactttgaagataggtccaagagagaagtttcagaagtgtttaaagggaagtagcataattgaatgtgaagtctttgtagaaaacaactttgaggttttttttaaaatagttaaaatttttggctgggtgcggtggctcacgcctgtaatcctagcactttgggaggccgaggcgggcagatcacctgaggtcaggagttcaagaccagcctggccaacatggtgaaaccccatctctactaaaaatacaaaaatttagctgggtgtggtagcacaggcctgtagtcccagctacttgggaggcttaggcacgagaattgcttgaacccatgaggcagaggttgcagtgagccaagatcatgccactgcactccagcctgggcaacagagtgagacttggtctaaaaaaaataaataaattaaaattttaaaaaattactatttctaaatgttttaaaagttagcattaatgtgttttcttttgcttttaaaaactgatttcattagctatcacgtgcaaatgagctatgagtcttgcctttaaagataaggtctggataaaattcctgtgactgagcagagcatttagggttagggagaaagaatgaagaacttgtgctgtgtggcgtttctatgctgtataaattcttgtttgtttataataaacatttttataatttcaaaccccaattaaaatttgacttatggccaggtgcagtggctcaaacctttaatcccaacactttgggaggccagggtgggtggataacttgagtccgggagttcgagaccagcctaggcaacatgacaaaacccaaaccccatctctacaagaaaatacaaaaattagccaggcatagtggcacatgcctgtagtcccagctactcaggaggctgaggtggggggatcatctgagcccaaggtactcaaagctgcagtgagccaagatcgccactgtattccagcctgggcaacagagcaagaccccatctcaaaaaaaaaaaaaaaaagctgtatgtgtgtgcccccttgtaatttttgggaaaagtgtccatagcttccatcagattcttaaaaaggtgctagattcaaagtttaagaactcctgccacacagagtgtaattcttttaggacctaaataaccctcttttggttttttttttttttttttttgacacggagtctcgctctgttggcaggctggagcgcagtggcatgatctcggctcactgcaacctctgcctcccaggatcaagcgattctcctgcctcagcctcctgagtagctgggactacaggtgcatgacaccacgcccagctagtttttgtatttttagtagagacagggtttcaccatgttggccaggatgatctcgatctcttgacctcatgatctgcccgcctcagcctcccaaagagtgggattacaggtgtgagccaccgcgcccggccaacttaactctttatatgaggttaaagttatgcccacactgcaaattgtgctttatagccaatgtttttagtaagttttaatatattttcctgtagttgaaggagaaatctcttagaatcttactgacctgatatttattatttttatatatctatttttttcctgtttgaaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttggtgagtgctctctatggttggaataaagagggaaaagtgaaggaggtgaacttctcttataaaatgttggcatttcccttcaaggaagctctaaaacaagttgagtttcttctctgctgattgcatttttatgggaagttcctccttcccaccattatcggaaatctaaggtaggtcaacttgacacttttgagtaagagcaagggtgaggaacctttctggtgaagaacctctgagttgcacagaattattcatcaaagatcacaaaaagtgaacgttgtatccattcatttggaaattaagggtaaacaaaattctgctcattaaatacaaaaagtaattaaatatattttagtcatatcataatcagctgaagtgaaagtgagggaaagacctggaaaagataccgaaaaaaggaattggcatacccacaaagaggagaaagatgcaataacacacatgcgaaatgagacagagagatgtgggctggcaaagaccggggggttcattgaggaataggaccgagtgctcgttctgtgagactccagagaatggaactggcaccaagagattgaagttatgaggagacagatgccaattaaaccctttagaagcaggaggggaatgcagaaaacacccttgagaagaacgccttccccatgaaattgacggtgttcaaactgaggctgataatgcattgctgagagtataaaagcagaattcatcaattcacaattaaaattttgatttaaatgacctatgagatttttatggcagtttgacatttcagattatgaacaataaaaatcttatgcaatgtttcattttctcaactagaggtgttttttaggtggaactgcattgccctttgcctagtccatggtgtgatgtgattgaaaatagagggccacactcagttttcaagtcaaagtttctccacctctaagattaacttcccttcttttccaaatcctgaggacctcatcccctaggggctgtaggcagaggatgagttttggaagatgagtacttgtgttgggggtccccaggagcaccttaaatttgttggttcaccagaaggactcacaggactcagctgctcatcatagtactcatggctaagatttgttaaagtgaaatgatgcagagcaaaatcagcaatgggaagaggtgcgtggggcaaagttgtgaggaaaccagttcccagccaccagcaaaggccctccttgcatgcagaactttctaaagatagcagtttcaggcctgctgtattaactctgctctacacagtactccaagtgaggcagctgagttttctgcagttacaatcataatgacacaattaattttatttgatataaaatcttaggtcaaggcaggtggatcacttgaggtcaggagttcaagatcaacctggccaacatggtgaaaactcatctctactaaaaacacaaaaatcagccacatgtggtggtatgcatctgtaatcccagctactcaggaggctgaggcaggagaatcacttgaacccgggaggcggagccaagatcacaccactgcacttcagcctgggcaatagaatgagactctgtctcaaaataaataaataaaagctcatctttattgtttaaaatatttaaaagggcaactcatcctaaaataaggtcaggttggcctcatctccctactgctataaaaatatttccattatgagaactgttttaacctatgaggacacctcatggctgaattaaaatatacctctagtgcccaaaatctgtagaatcttctgctgtttcaaaatcaagtctgattgattggtgatatgaatgtatgggtagatatttagaaataggggaccatatgttctggtctgcctgagaccatccatatgcctgttgtcattattaatagtcctctcgcttgcatcctcacagtccgtctgcctattgtcgttattgctggtcctgtcccttgcctcctcacagtctgtctgcctgttgtcgttattgatgctcctctcccttgcctcctcacagtccgtctgcctgttgtcattattgatggtcctctcccttgcatcctcacagtccgtctgcctgttgtcattattaatagtactcacccttgcattctcaaaatgtactagtttgtgttgataaattatatggtcaccctacttagaaggtacaaagaaagaataaaagaagaaagttcttcaccccatctcagaataaccaagatctttatctttgctggggtactaccccaaggcaattttttttggataccattttttaaccttgacatagtggatacatcatttcttcctccatatatatttttcctccattaaaaaagaaacaaaaacttttttatacctgggttttgctcttgatttagctctcaaggtggtccttgtttactttttaataatcactgctcttcatctgtcaatatttaattggtatgatttatcccaaaattgtttatagaaagtcagttttttgttttcaactctagatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaattgtcctttgagttatagaaaataatggaattgggatttctacatatcattattatacctattttaaatttaatggcagccaggcatggttccagctacttgggaggctgaggcaggaggatcgcttgagcccaggagttcaaggctgcagtgagctatgattgcaccactgtattccagcctgcacgatagagttagaccctgtatcttaaaaaaaaaaaaattaatggctggtatatagtaaacttaattcactgttcccattgttctaaagaatttttttaaataatgtttcattaaatcttatgatttaaccgtgcttgccctttttgccagctatgtggcagtttacggcagaactgctgtcagtgtgctggtagccctctattcatccctcctcagagcccagcttccagaactgctatcactgtgctggtagccctctgtattcatccctcttcagagctcagcttctggttgtattctccatgagtttaataatgacatgaaaaaatgtggaagccgagagagtaaaatactctgccctgtaaaaacatggaagacatgcaaacagaaaaaaaataattgtattgttttagataatacttaagacaactgtgaaacaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaaaagaaaaaagaaaaaatatattcatgaatgataggcgatgcccattctttctctcaagctaatgaagtcctatggcattctaaccacaaccctcggacagactcctcctattcctccatggcattgtaaccacaaccctcggacagactcctcctattcctccatggcattgtaaccacaaccctcggacagactcctcctactcctccatggcattgtaaccacaaccctcggacagactcctcctactcctccatggcattgtaaccacaaccctcggacagactcctcctactcctccatggcattgtaaccacaaccctcggacagactcctcctattcctccatggcattgtaaccacaaccctcggacagactcctcctattcctccatggcattgtaaccacaaccctcggacagactcctcctattcctccatggcattgtaaccacaaccctcggacagactcctattcctccatggcattgtaaccacaaccctcggacagactcctcctattcctccatggcattgtaaccacaaccctcggacagactccttctgttcctcctttcctcgtccttccctgcttttcgtccattcagcatatagctattcagtactccattgaagaaattatgctaagtgagcaaagcaacataattactaagaattaattctgattatttggcactagagccaacagcaaccccagcacagaggaaagtcgcttttttttcaaatgcataaatttaaagtatgtatttgcatgcagttttaaatgggaggtatttgtcattgtgaaaagctgggaatctcaaacatagtcaacttaactaaaaagaagctaatacaggttgagcattcctaatccaaaaatccagaatccaaattgctccaaaatctgaaactttctgaatgctgacctgatactacaagtagaaaattccacatacaagtacttaacacaaactttgtttcatgcacaaactactaaaaatattgtataaaattaccttcaggcagtgtgtgtagttatatatgaaacatgaatttcatgtttagacttgggtccatgcccaagatacctcattaggtatctgtaaatatccgaaatccaaaaaaaagtctgaaatctgaaacacttctggtcccaagcatttcagtaagtgatgctcaacctgcgtaatggtctgcgggccagtgctcattttctgcctatgttgtacatactttaaattgtgtaaattaaaagtcaaagcaaagagtctatttttaaagaaacttacaataatctaaacatatacttcttatgattatgaatcatcctgcaaagctgaatgaagaattttaccaaaaatacaatgaattaatcatatatttgagagtcacagtgataggttcgactatattttgactgttgtgtagtggcaccgtttaggtagtattgtttctgagcatggtgctttttatacttgaaatatatttttgctttattttttattgatataattatatttgcactaatggctttctgaagaaaatattatagatgacattttttgtatatatatttattaagcttgggaacctggtcgcccagtgttttctctggacaaatgtgaaactggataaagtatggataaagtcttgagttcctcagggtaactgtgttgatgtctcccgtcctcttcagtaaggcttgaatatgattttactcatcattgattctgcatagtgtacccagcaagacttagaaggacactgaacctgtcagagattttaagaggcacattttagtcactttgaatatggtagtggtgggcgcggtgactgaagcctgtaatctcagcacttcgggaggccaaggcaagcagatcacgagatcaggagtttgaggttacagtgagctgatcgcaccactgcactgcagcctggatgacagagtgagactttcttgggaaaaaaaaaaatgacagtgaagcagacttttagaatccgagatgtcattgcagaattattggtataaaattcagctgcaaagtgaagaaattgaaatggcccacacgttgatatcctgtggcaggttatacccttcatgttagcaaagacgaagccacgtcgctgtgttaagagggacaggctgggccggctgcagctgtagtggaagtgagggacacagggaaggaatggggagcagcaatttggggacagtagactggagtcactttctgactcaaaaagggtcaagtacttattaaaaactatcttggttttctgttcagacttaggctcattttgatcattttaaggtcccagttgtcaaaaatatcaagtgaatttgtctcaggttttcagaaacaaaatttacaggaaggaagcaaaagccatgtcagtagccttgagctgacagctttaaagaaactggcaaacaggtaggttgtcctcatatagatccttccagtattctgaaaaacatccttttatttcttaaaaccagtaacccttacatttttcctataggatagttatttttgttgagatcaaatagacattctataaatgttataaattatgcttgcagttactcagcctatctaggcttaaggtttatcaatatttgaagttgaaacatcatcttatgaggtttagttttaggaagataaataaatatatcaaagtatttcataaagttgtatcaatgttccttctaacattagaagacttactgactgaggccatctgtgaacgactaggtgatctcagaatccttccagctctaataccctctgactaacactcacccagaattgctgtctgtgctggctgtgatctgcctccaggagcatacgccatcctgcgtgctgtgtccatcacagtgtctgtgctcggtgccttaccactgtccgtgtccttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaa

SEQ ID NO: 448 - DNA, 83522 bp, Homo sapiens; identical to SEQ ID NO: 447

SEQ ID NO: 449 - DNA, 83522 bp, Homo sapiens; identical to SEQ ID NO: 447

SEQ ID NO: 450 - DNA, 83522 bp, Homo sapiens; identical to SEQ ID NO: 447

SEQ ID NO: 451 - DNA, 80313 bp, Homo sapiens
tgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcgggtgagcggggcggggggcgtctctgcccgtcggagacccggcgccgggagccgccccggccgggggaggcggatgcgggggagttacagcagctcgtcccgtaggcgccgggtccggacccgggtaacggggagaagccgacggcgccagccctccgggcctgcgccagacccagagcctggggagaggcggcgggcggcggcatctctcggggaagggggccggagtgattgatggatgattttttaggctttctgaggaaaatcagtttctgccacggcggaggtagacccttgccccgccccggtttctgcaggccctttcggatttggggtgccgaatggacctgctaagacgggaacgttagcgcgagctcttcacagatcagagtagcaggggtgtctggacgagctgcattgtcaggaagggtcggtctcagccctggagttttttcgaaagaagtgttggggagcgtgtgtttaaagtggacccgaaagaagtgttggggtgtgtgtgtgtttaaagtgaacccgagagaagtgttggggtgtgtgtgtgtttaaagtgaaccccaaagaagtgctggggtgtgtgtgaagtgaacccgaacgctggaacgtctttcttcgcctccatctagttgacttacaaaataaatacgcttgtaaaaataactagagcccactttccgactcccattagtttcctcttccactcctcatgtcctccaaaaaaaagttgaagcaaactacttagaaaagatagtctaacatatttgtacttgctattcctttttaaagcattacttcgtgttatgtatgttttcgaacacaggaaagagaataagaaagtaggtattatttggctttcttagttgtggcgaacagtgtctggtgcccgagttgttcatcatcatgtttgcagtgccgtcatcactgctcactgcagcctcgacctcccgggctcaggtgatcctcccacctcagcctcctgagtagctgggactacaggcagccgccaccacgcccagctaattttatatatatatatatatatatatatataaaatatacatatatatataatatacatataaatattatatataaaatatatatatattttttcgagacggtatctcgctcttgtctcccaggctggagtggaatgacacaatctctgctcattgcaacctctgcctcccaggctcaggtgatcctcccacctcagcctcccgagtagctgggactacaggcgcccgccaccacacccggctaatttttggatttttattagagacgggatttcaccatgttggccaggcaggtctcgaactcctgacctcaggtgattcgcccgcctcggcctcccaaagtgctgggattacaggcgtgagccaccgcgtccggccaatattttgtatttttttgtagagacggggttttgctatgttgcccaggctggtctccaactcctgggctcaagctatccgccgacctcggccttacaaaaggttgagattacaggcgtgagccactgcggctggcagtacttggtgtcttattttattttaaaatcttagattgagcacattttctatgctttgcagtcattaaaaatttataagtattacatatgattcactcattttggaaaaataaacagaactgttaaactaaagaagcgattctttccaaagaaacttttgctgtagtttaaaatagaagaaattaaatgcctgcttatttaatctctttttggaaacagttgaactgaatattttttagtgatttaaagtttcttgctaaggtaaatatgagcagccactttccttttgtgtgtgttctggtagacggcatgtaaaattatcattcacacctcagatttcctgcttctgtttaggagatggctatatggtatagtgatttcatattggtgtgagtcatttcattgttactacatcaagcctgaagctaaagaacaagttgattacaggagtctgtctagctcattttctcacctgcttttcagtaggtctaggagcaccgtgttgagtccttaaatattttattgactaagaaaatccaagtgcatttatgaagaataataagtaataccaaagaggtttttccttactgtgctctgagtttttaagtatggtgttgcctacactttaatagttttgtatagaaaccacattttttgttggttgatttttcatctggtcaaaacgtgtaaaaagaaaataaaaagattacaaggtattttataagctattagactagattcatttctaacatgtagtaatatcacttatgaaatataaaaaaaaatctttggcagaccttgctcgttacccagtctctgttttaaacagataatttaatgccaatgacatcatttattgagtgttcactatttgtaattcaccgtgttagatattttgaaatatactgccttgttaaatgcacacaataatttgtggattaaatactatccccactttacatgtgagggatcacctagagaaagtcatatggctatcaccactatatagtatcactggtaggattttggcccaggttatagctatcaccactatatagtatcactggtaggattttggcccaggttatagctatcaccactatgtagtatcagtggtaggattttggcccaggttcatctaactctgttctttccactgtaccatgcaacctcttcatatagaaataggtgttgctgttcctgtttttacagatggtggaaaccagcatttagagatgttcactaatttgctcaaagatctgtggctaaaggacagaggagacggtattagccaggagtttagtctagtttgaggtgactccaaaagccatagtctgtttttatggcaggtactttgattaatttggaaccaacttatggtagttattaggtatgcttagaccttatagaaaatttaaagccaagtaaaattagttgaatgctaatatataaaagttgccttgcatactgttttttcataatgtgtagcatgtacatggtagagctgttgtccttcaaattcgtatcctagggaacagcatatattgcccatatttataattagacatgattttgaacttattgggaacgttttcttgggactttctgtgctgtttattttgaaaggttaatctggctgggcctggtggctctcgcctataatcccagcactttgggaggccagggcgggcagatcacctgagatcggaagttccagaccagcttggctaacatggtgaaacccggtctcaactaaaaatacaaaaattagccaggtgtaatggcgggtgcctgtaatcccaactacttgagagggtgaggcacgagactcgcttgaacccaggaggcggaggttgcagtgagctgagattgtgccactgcactccagcctgggtgacagagtaagtgctgtcttaaaaaaaaaagaaaaaaaaatattaatcttttggaaaaggggaatatttatttgggaatgggtgacttgatccagtggacaaggaaagtcttagaagacatcacagaagacttcttgaagcagaaaggatataacttggatttgggcaagcagaaacaagaaggaaagctattttaggcagtggtggacagcacgcaaaaaatgttaagagtataagggacatcagttaattttgccagtccattattcagtcccttctggtaatagtactccaattttcctagggaaccacccctctcagttatatgaaccccaccctggcatagggtatgccagtgactcaggcctagctaatggtcagtcagtatatagtccattgctctggccatagtgattgttcagaggtgggcccattttgcaatcagcacacatgagtaactgaattttttgttgaactattgagaaagaggcatgctttgagccctggggttgctgagacaataggatgttagcctggaagttaccaataagtgggaagcagagccaaaagatggaagttctgatggcagtgtttgtacctttgggtcagccgccatgcctaaagtcagtgctatctctgtactttcaaattatgtgagctaataaattcttctttctgcttaaggtgagtaaaaaagttgttgttttttttttttttttttttttttgagatggagtctcgctctgtcacccaggctggagtgcagtggcatgatctcggctcactgcaacttctttctcctgggttcaagtgattttcctgcctcagcctcctgagtagctgggactacaggcgcccaccaccacgcctggctaatttttatatatttagtagagatggggtttcaccatattggccaggctggtctcaatctcctgaccttgtgatccgcccgccttggcttctcaaagtgctgggattacaggtgtgacccaccgcacccggccagaattttttgatgataaaaaggtcctgactaatacagtgaaactacccgtgatgatattgtggtgagacaaatttggtcaaaataaattattggattagagaatataagagctgcctttcgtatatgaggaagctagatagccaatagctttagaggtcagcattcattcaacagacatttattgactaaaggacttcggcagttattggtgtatgaagaggaccaagacactccctgccctgacagaactcaagggatctaatggggagatagacgggtggaaggattgtttgaattgtgcaataatagcacaactactatgttttaggcattatgctgggtaatgtagaggaaacaaaaatgaggccttacgaatatttttaaatctagtaatctggttgggtagctgcataacagaaagctgtgagggaatgaaatcctggtacactgagatcatactggacaatgaaaatgtacaaatgctgattgaatttatttaaaaaaggataggagtccaagatcactgttaaacctgtaagactagaaagatggtaatgctattgcttataatagtagctaacatttattgaggtcttaacatattccaggtattgtgctaagctgtgtgtgtctatatataacatgaacaaaaacaaccatagtaagttgtaaatactatttttgaccccattttacgtgtgagaaaattgaggctcaggagattaaataatttgatcaaggtctcccagctaataagtgacaaaactaggattcaatttctgatacatttgaccctaaaatttgtgttattgatcaataattataccgacaagttggtttcctgtaatttctttggtttgcccaatatctttgaagggttggtagcacatctagtgaatcatgtgggacaaatagaaacaaatagaaactagagctttagaatgtagagtgacactttaggaggctgaggtgggtggatcacgagatcaggagttcaagaccagcctggccaacatggtgaaaccctgtctctactaaaaatacaaaaaaatttgctgggcatggtagcacacgcctgtaatcgcagcactttggggggccgaggcgggcagatcacccgatgtcaggagttcaagaccagcctggccaacatggtgaaaccccatctctattaaaaatataaaaaattagctgggcgtggtggtgcatggctgtaatcgcagctacttgggaggctgaggcaggagaatttcttgaaccctggaagtggaggttgcagtgagctgagatcacgccattgcactccagactgggcaacgagcaaaactccatctcaaaaaaaaaaaaaaaaaaaagatgtagagtgaagttaattaaggctatggaataaattcaagagagtcatagtgagagtttataagattcttggaggaaggacgtagagaatggaaaaggtaggcactgtcaactcagggagataccagcattttaaaaggtggaaagaggaatcagtctgggaaaaaacagaaacagaaaaaagattcagtaactaggcctgtactagaattcatagaatcctaaaactaggccgggcgcagtggctcacgcctgtaatcccagcactttgggaggccgaggcaggtggatcacctgaggtgaggagtttgagaccagtctgcccaacacggtgaaaccccgtctctactaaaaatacaaaaaatagctgggtgccattggcaggcgcctataatcccagctactcaggagacaggcaggggaatcgcttgtgccggggaggtggaggttgcagtgagctgagatggcgcctctgcaccccagcactggcaacagagcgagactccatctcaaaaaaaaaaaaaacaaaaaaaacaaaaaaaaaaacaaaaccagaaaaatcctaaaaccagaaggaaccatagtgaccttctaagttatttcacaaatgagaagcaatctgaagctgggtgcagtggctcacgcctgtaaccctagcactttaacactttaggaggctgaggcgagtggatcacttgagcccaggagatggagaccagcctgggcaacatcgcaaacctcgtctcttaaaaaaatacaaaaattagacagttgtggtggaatgcatctgtagtcccagctgcttgggaagctgaggtgggagaatcgcttgagtctgggagattgagggtgcagtgagcggaggtcgcaccactgctctccagtatgggcaacagagtgagaccctgtctcaaaaaaaataaataaataaataaatgagagagaagcaatctcagattaaatgatattcttaacgttgtatagtgaggtgatactgttttacacaaggcaaataagagtcatagctgaagcttgaagaaaactcttgaatgaaatacagaaaatgagaaagcaaagactcaccattggtgtaaagcctacaggtgagagcaggatgctgtgggcaggtggactacaatcacacacagaaaaaggaaacattgacatgtggcgggtgagccaaagtaatgcagtgtcattggagctatgagaattaaaattttcaagaaatgaatactttctaggtaagaagaatgaggactgctaaaatgccatttaattttccaaggaggcagtctgtaactcacaaaattatggtttcattagtcttggaaatacggactagagtaccaggtcttaatttgagattgtgtttttcttggatccttgtttatgtctattttgtaacagtcacagtatatgcactatgaatttttctagaactgtactgtgtagtatggtagcaactagccgtaagtggttattaaaatagaaatttaaaacttggttcttcatttgcactagccacatttcaagtgctcagtagccacatatgtcattttggacagcaccttggaccaacctcctctctgtcatactggacagcacagataatagaactctctcatcactgcaggaagttaggttagacagtacgttagactcccctgagattggtcttagaagggaaggggaggtagtaggatggtttctttaggggaggtgagaagatgaaccatagaggaccactgaaccagttttgagagtacgggagtgacagcagtgctggggctgaggagttcccaggttccagttccttttacagtggctatatttgggagctggatggttaacgttacttcatgttagaacatcaagtatgactttaagtggtgtggttatatacatgtttcttgttctttccagttcctctgtaaaatatcccaggtgcgcttgggaaaaatgtatggtcaatgtggtaattcacacaaaggaatattattttgaattcctgaagcagccagcaatatcaaatgcagtgtgactaattttagaatcaaactagtagtaaaaatgtaaagcatttccttattcacttttaactttcttctttgctcttcacaatttctaaatttttattgtttgaaggaagtcttaaaccttggatttaaactggtttaactgatttcttatttaaaaactgggtaatagattttcccattaaaaacaggtttttggctaggcgcggtggctcatgcctgtaatcccagcactttgtgaggtcaagatgggtggatcacctgagatcaggagtttgagaccaacctgaccaacatggcgaaaccccgtctctactaaaaatacaaaaaattagctggctgtggtggcacgcgcctgtaatcccagcttcagctactcgggaggctgaggcaggggaattgcttatcccgggaggcagaagttgcagtgagccgagatcacgtcactgcactccagcctgggcagcagagtgagactcgctctcaaaacaaaaacaaaaaacaaaagaacaggccgggtgcagtggctcatgcctgtaatcccagcactttgggaggccgaggcaggtggatcatgaggtcaggagttcaagacgagcctggccatgatggtgaaaccctgtctctactaaaactacaaaaaaaaaaaaaattagccaggcgtgctggcaggtgtttgtaatcccagctactcgggaggctgaggcaggagaattgcttgaaccccggtggtggaggttgcaatgagccaagatcacgctgatcgcaccactatactccactccagcctaggcgacagagtgagactgtctcaaaaaaaaaaaccccacagttttttaaaaatgattttcatatcatagagagtgggaaggtaagccacagtcttcttaagatttccaataaatgcaacagattagatccagaatatttaagaatgtctatacacaagtaagaaaaagacaacccaggagaaaactgagaaaacacttgaactagtactttactaaagaggaattccaagtggccaataaatgtttgaaaaggtgctgaacctcatcagtaatcaagagattgaaaaataaaaccacagtgggtactactttacaagttgatgattccaagtactggaaagaacgtggagcagtggagacactcatacgatgctgtgggagcttgtgggagtgtgaattggtgcctcaactttgaaaatgctctggaacgatccaggaaggtttaaaatacacatattctgtgactcagaaattccactcttgagataaatctctcagagaaagttgtgtgtatgtataccaggatatatagtatgataagactgtccatagcattattcatatttgacaaaatagaaacaacttaagtgatgatcaccagtagaatggataaatcaattgtgtgaaaatgagctggccaagtgcggtggctcacacctataatcccagcactttgggagtttaaggtgggtggatcacaaggtcaggagttcgagaccagcctgaccaacatggtgaaaccccgtctctactaaaaatacaaaaaattagccgggtgtggtggcgggcgcctgtaattttagctactcaggaggctgaggcaggagaatcgcttgaacttgggaggcagaggttgcagtgagctgagatcacaccacagcactccagcctgggcaacagagtgagactccatctcaaaaaaaaaaacaagaaaatggatgagctataactatatgcagttgcaggaatgaaccttagaaacataatgtcgagaaagtgaagtgtgaagcataatatatacggtgcaaatatatttagtaaagttcaaaaacaaaaaatataagtgctaaaagtacaaagaaaaggaaataattgccataaaaatcaggataatggttacctctaggggagaaggaaaaagctgtgattaggaaagggagctttgggttgggagtcagggatatatttctgaagtattggaaatactctgtttcatgaccttggtggtgattatatggttgttcatgttatacttttaaaaaattgaattgtatgtttatgatttattcacttttcttcatttatgttcgacttttgttgaggctaacttcttcattgttaactcatgtatttctcatggcacctcttctttttggccatctctttttaaattctcttcctttctctctaccatccctcctccccagttaggcacttattgttttcttaataccctgtgcacatttttttattgtcacagtaaacaatatcatcttttcttctactagattggcagcttcttgaaggaggtatattagttttctgttgctaaatagcaaattattacaaatttagcagcttaaaatagcatccatttactatagttctataggttaggagtctggactcagctgaactcaaggtttcacaagactgaaattaacgtgttgtcaggatgggcttttatctggaggctttggggaacagtttgcttacaagttcattcgagttttggcagaattcagtctttgtggttataaaactgaggttcttatttcctttctggttgtcagcctcaggccactctcaggtcctggatgccacttgtattcttacaacatggccccctccatcctcaagccagcattggtgtgtcatcaaacacttctcgtgcttccagtttctcagacttcctctgctgctgctatccagagggttgatgtgatgagactgggtttaccaagattgtgcctcttttgattaattctaaagtcaactgattagtagacttcattacatcagcaaaatcccctcttccacataaggaagatactcagggtatgagatcctgtattcacagttccaggaattagagtggtgtctttgtccattttgtgctgctataacagcataccacacacagactgattaatttatgagtagaaatttgttggctcacaattttggaggttggaaagaccaagatctaggtgctgccatctagtgagggccttcttgctgtgttatattttgttgaagatttttccatgtatgttcatcagtgatagtggcttgtaattttattttttgtgtccagctttggtatcagggtaatgctggcctcgtaaaatgcgtttggaagtattcccttctctttagtttttttaagagttcgagaaggattgttattagttcttcatatgtttggtagaattcagcagtgaaaccatggcttttctttggtgagagacttactgattcaatccttactcattaatctgttcagattttctgtttcttcatgattcaatctcgggaggttctatgttcctaggaatttatgcgtttcttctgagttatccagtttgttggcgtataacttttgagtatttgttgaatgaatggatgggtgaatgataaagcgaaaagaagtgattgagagcctgttcactttcatagctttggaacagtgacacctgcctgctgtataaagtaactggtttcagtggggaccctgggagtttcaatcagaacattctcaaggataatactagtgagtatgcttctctttggtgtgaaaaagtcaagcattcagaacttttaaaattggtgtcatagaggataagagaaatgatgttacatgtgctaagagttgttttctcaaaataaatgtcaacttctaggtatttgggaactttcacagtggattcattgattataataaaaggaataaaaatgttaaaccttatatgtagtgaaggaggctttctctgtttatccagtgttttcaactttggtagttatatgtctcacttgtgtaaggaaaatcttagtcagataatgtggtcatgcttcttttagcctataaaatttgtggcttctggccatctattatcaagtgacaagctgtagcatattgattctcaggctttagtgttgtgcatagaatcacctggggctctttttaaaaaatacgcatccctgggtgagattactagagagattcaggagatccggggtggagtccattaaactacatttttaacaagcaccctgatggtactaggtgcaggtagttaagaaccacctgaaaaacatttccttagaatttgctactttagccaggtgtggtgatttgcgcctgtaatcccagctacttgggaggctgaggcatgagaatcacttgaacctgggaggtggaggttgcagtgagctgagattgcaccactgcactctagcttaggccacagagtgagactgtttaaaaaaaaaaaaagaatttgctcctttactctaaaagttattttggaggatagtggtttttcacatctggttctatggcatgccatagaaggttcgcaggaccttgtgagaaatgcagaattgcaggcctcatctcggaataagaatctgcatttgcatttcagtttaagaagcactgctgtaacgttaaccaggtaattctttttccaaagggtctcagtaagtaaataattggccttagttaatttaacccatatgatatggggcgaccaaattgaatactttcaacatcagtctattaaaaaatgaaaagggaccgggtgtggtggctcacgcctgtaatcccagcactttgggaggctgaggcaggtggatcacttgaggtcaggagttcgagaccagcctgaccaacatggtgaaaccccatctctaccaaaaaatacaaaaattagccaggcgtggtggcgtgcacctctagttagttctaggtactagggaggctgaggtgggagaattgctcaaaccccagaggtggaggttgcaatgagccaagattgtgccactgcagtgggcgacagcgtaagaccctgtctcaaaaaaagaaaaaaaaaaagacccactttgtgggtggcaataagcaaagaagaaagttatgacaccagttgccttgttcctaggatatgatgtgctgaacatatcatggatatgtacatggttagagtttgatgttagcaagtccttttagactgtgccttgcctcagctgcacccctccttaagttatactggaaaataaaaaaaccttcgtatgtcatcccagtaggtatggtaaggatccagagtgcagaaatcccatcgtgtatccagagctcaattatcttgtcctcactcctatcctgaggactggggctttccacccaaaattgttataccagaaacagggctctactactcattggtgtatttgtttctagtacctacttttaaaagactgttacttgctcagctgcttatcttgcttgtgaagacaatgtttagtaacacgaggagaactacagacattatcgtggtccaatcaacagtgaccatcacaggtttgttaattttgctgttttatcataatacttgcagttagtaaacacttccttattttctaatgtaagaatgacaaatagaacttaaagacatttccaatagaatctatctgtacctcgattatccactcctttttttttttcttttttatttttttgagacagagtctcactctgtcgcctaggctggagtgcagtggtgtgatcttggctcactgcaacctccacctcctggattcaagcaattctcctgcctcagcctcctgagtagctgagattacaggtgcgtgccaccacacctggctaattttgtatttttggtagagctggggtttcaccgtgttggtcaggctggtctcgaactcccgacctcagtgatctacccgccttggcctcccaaagtgctgggattacaggcgtgagccaccgcgcctggccaagaaagccattttttcaagtcattcagaatatgtgattgcttttcctgaggggcaaactgataaaacatgacatgttggactatccttgataacttttccagtaagacacttttttcttaagggtcttacctctatcatatttttgaaggagaagaacgtgcaacagaaaaatcaaggaggctttttcttcagagggctgggactaaaactgggtctggatttgggtgtaggcttgctaaagagggggacacgcctccaaactgaaaacctaatgacagccgacatgcagaatggtaagatctctaggcatctccctgcttggctgatatactcctctgattattggagtttttagagggggacacgcctccaaactgaaaacctaatgacagccgacatgcagaatggtaagatctctaggcatctccctgcttggctgatatactcctctgattattggagtttttagagggggacatgcctccaaattgaaaacctaatgacagccgacatgcagaatggtaagatctctaggcatctccctgcttggctgatatactcctctgattattggagtttttggagaaaatctaggggaaaagagaaaagattttaaggtatcggtacttacagaacccaaatgaaacagccaggtccctacactgtaccttacagggaagtgtacatacagagtttccacccagaatttcaatgttatgggttttttttgtttttgtttctgtttttttgagacggaatttcactcttgttgcccaggctggagtgtaatggtgcgatcttggctcactgcgacgtctgcctcccgggttcaagtgattctcctgtctcagcctcccgagtagctgggattacaggcatgtgccaccacacccggctaattttgtatttttagtagagacggggtttctccatattggtcaggctggtcatgaactcccgacctctggtgatccacctgcctcggcctcccaaagtgctgggattacaggtgtgagtcactgcgcctggcctatgtttttaaatatgaaaagaaaactaaatactactagatagttgaagaacatttctcttttttcttttttctaattttagtagagacagggatcttactgtgttgcccaggctggtctcaaactcctgagctcaaatgatcctctcacctcagcctctcaaagtgctaggattacaggcatgagtgcctggccttgaagaacatttctgacatcaaagagaagaacataacaaaaggaacccagagaaaacagacagtgctgacaaaagaaaaacttccaaaaatctggaatcaatatcctaaaagtcagaaaagaaggtactgcagacatgaaatataataagggtctctaagaaaagggcataggaatgccggacatggtggctcactcctgtaatcccagcactttgggagactgaggcaggtggatcacctgaggtcaggagttcaagaccaccctggctaacatggtgaaaccctgtctctactaaaaatacaaaattagtttggtgtggagtttcaccatgttgtccaggctgcccttgaactcctgacctcaagtgatccacccgcctcagcctcccaaagtgctgggattacaggtgtgagccactgcatccggctcctgagaccccatttttacaaaagatttaaaagaaaaattagcctgacatggttccgcattcctgtggtcccagctactcaggaggctcaggtcagagaatcacttgagcccaggagttccaggtttcagtgagctgtgattgcaccactgcaccctagcctgggcgacagggcgagaccctgtgtcaaaaaaaaaaaacaaacaaacatgcatacacacatacaagagttaaaagtgattgctttaggggagcaggtattgggagttaatgaggaattagacctctcctgtttgggtgctaatttttactttcagcctatatccttctacttgaagtgagtttcttgtaaataacatagagttgcattttttttttttttttgagacggagtctcgttctgtcgcccaggctggagtgcagtggcgcgatctcgggtcactgccagctccgcctctcgggttcacaccattctcctgcctcagcctcccaagtagctgggagtacaggcgcccgccaccacgcccagctcatttttttgtatttctttttagtagagacggggtttcaccgggttagccaggatagtctcgatctcctgaccctgtgatccgcccgccttggcctcccaaagtgctgagattacaggtgtgagccaccatgcccggccgcatcatgtttttaaatccactttgctaatctctgtattttggtcatttgatctgtcttttagataatttgtatttcatatcattgttgatgtgttagggcctaagtctgccattttatttgttgtttcctttgttttcctttctgtgttctttttcttgccttcctgtggggttcgtgaacattttttagaattccatttttatttctctgtagtgtttttgagtgtatctctttgtgtagctctctttgttgctgccctaggtattacatgagagaagtccaacttgtcagtctattggtatccttattttatgagtttgagtgacgtatagaaaccttacccccttcatgtcccttttctttccctgttatagttgtcttaaatattttctctataaatatttagaatcacatcaaacagtcttataatttttgcttccaatataatttggaaaactcaagagaaggaaagtcttttatatttacccatatttttgcttagtgttatgtactgaattttgtccgtcacccacaaattcatacattgaagtcctaactctcagtatctgcgattgtgtttggaggtagtacttttaaagaggtaattaagttcagatggcatcatttggctgggctgtaagtcaatacaagtgatgtccctgtgagaggagattaggacaaagacaaagaggaaagatgatatgaagactcagagagaagacagcatctgcaagccagtgagagagacctcagaagaaagcaaccctgctaacaccttcatctcagacttctagcctccagaatttgagaaaatacatttgtatcgtttcagctgcccactgtgtggtattttattgtggcagctctagcaaactcatacgctgtgtcctttcttggtgttttaagattcctttctttcaccacttactttctatttagagaacttccattactcattcttttagattacatctgctgctacagactctctcagttttcattcatctgagaatgtgttgatctcctcttgattcctgaaggacattttgctggatatatatacaattctgggtgaacagtctttcttttagtgattggaagatgttgggccaggcgcagtggctcatgcctgtaattgaaacactttgggaggccgagatgagcagatcacttgagcccaggagtttcaagaccagcctgggcaatgtggcgaaaccccatctctccaaaaattagctgggcatggtggcacatgcctgtagtctcagctacctggaaggctgaggtgggaggatcacttgagcccaggagatcagagctgcagtgagctgtgattgtgccactgcactccaacctgggtgacagtgagactgtctcagaaaaaaaaaggatgatgttctgccacttctttctggcttccatggtttctgatatgaaatctactgtcatttcaattgtctctctcttactgctttcaatattttttttttcttggccaggcatggtggctcatgcctgttatcccagcagtttgggaggccatggcaggaggatcacttgaggtcaggagttcaggaccagcctggacaacatagtgagacgtcttctctaccaaaaatacaaaaattagtcaggagtggtggtgtgtgcctgtagtcccagctcctcaggagactggggtgggaggatctctcgagcccaagaggtagaggttgcagtgagccatgattgtgccactgcactccagctggggtaacagagtgagaccctgtctaaaaaaaaaaaaaggactttttttctctgtcttccgttttcagaagtttggctatagtgtgtcttgtggatgtctttgggtttatcctctttggggtttgctcagcttcttgaatctacaggttcatgactcttgccaaacttaggaagctttcacttcagttcatttttcagcccttagaaatgctgaagtattcagccctgagctccttctcttttgccaggattctgatgacatgagtgttagattattgttacagtcccataagtccttgctctgttcagtctttttttttttttcccccaatctgttttctctctgttgttcaggctgggtaatttctgttctgtcttgcagctcactgattctttcctctctgccctccgctctgctgttgaacccatccattgagctttttctgtgtgtttgtttgtttccccttcatatcttctttcttgagaccttctgttttttgttgttgttgttgttgaggctttctggttttcatttgttacaagagagtctgtaattgctctctgaagcattcttaggatggtctagcatctctgtcatcttagtgttggcatttattgttttttatttggtttgagatcttcctggtccttagtattgtaaatgttttcagttgtgcattttggggattataagagtcattacagtctggcaaggatggaaatttaggatccccacgtaacctttgagtaggggtgaggctactcaaaggttgcatgggaagcctgtttttttccagtttttttctgagatatttgggtggaatagagcagttattatctaaaagttttctgtcttgctaagctaccctttcctggtgctttattattattttgttatttttattttttgagatggagtttcactcccaggttggagttcagtggcacgatcttggctcactgcagcctccgcctcctgggttcaaaggattctcctgcctcagcctcctgagtagctgagattacaggtgctcacgaccatgcccagcttatttttgtattttagaaatggggtttcaccatgttggccaggctggtctcgaactgctgaccttaggtgattcaccagcctctgcctctggaagtgctgggattacaggcatgagctaccgtgcctggctattttatttttaaacttggagaggtcagctccaagtctgggatgcatgaggcaaaaagaaaacccagggaattcattgctattgttccttgagtcctgaggttcctagccatcttctctcaaccttttatctgttttatgtatattatctcgggtttttagttataaattaaaattttacataattttagagatttttaaggtacatgtcactaacaagaggcagattacatttctactttgagtatacacatttaattttttaaattattgtggagaaaaaaaacagaaaaaggaaaaagtacatttgtttcatcttcccagaagcggaagtcactaaaatggcatttaaagttatataaatatactattttgataaaaataaaagttaacagtttttaaaagataacctaaagtcaggttaaaaaaaataagacttttgaatgaaaagcattagaaaaactatgttttgtgatctccctgggttacataattaatattaatagctaaaatgatttttattgcattatctcagtaaaattttcatgggaatggtaaggtggttgaaaacgaaaaggaaatacctaagcaaggagtgtttttaaatgtgacagatgtaaacagaaagtctgaaaagcgtaacccactctcatgactcatcacggggtcttcagtgactgcgctgccgtctatgttcttggtgtttaaactttggtctgtgggacgcaccatgaacagtatcattgtgatatgttacatagctatcaaataatattttaaattattacttttatataattctttagggactttttgaaaattactttttagtttatttcatactgattgtgtatttcagaaattttcatagtttgcatttaccatttctttatatgttaaagaatattattcctataatattctttacagttttacattgctcagtgttgaaaatctcttatacagattatttgtcatcatccctggccattttcgcattcatagtagtgtctgttctcacagaaaatgatggtactgtacatgtgggttttgcataatgggctgattgggtaaggatgatgtcactgcgtgggaccgcctggaggagttattagaagaacacaagacttttgactgctagcatttcttaataaatgccatactgttgaaaacattaatttgtgtttggactggaatgaaccttggttttcctggcttagttactgagatttaaagaaataagtcctaatgtcataattacatagccaaatagaatgaaatatgaagcatttttctccctggcagagagaaatggggttaagaaggaaagaagttactaactgccagtctctgttacacagttgtgagactaatttttgagatttgaagttcaggaatactttgaaattttgtttctgtaatttgtgtattattcattttattgctgagacataagatatggttattagaaaagtccataattttagagatttttaaggtacatgtcactaagaagaggcagattacatttcttttctactttgagtactacatgtttgattttttaaattgttgtggtaaaatatgccattttatccatttttaagcatctgttcagtggtattaagtaccttcatactgttgtgcagctatcaccaactaaatccacttccagaacttttttcattatcccagactgcaacactgtatgcgttaaacactaactcctcattacttcctggtaatcattctgctttatgtcttttatgaatttggctgttctagggacttcatataaatgaaatcatatttatcctttgatgtctggcatatttcactccataatgtttgcaaacttcatgttgtaccatgtcaaagaattttattcctttttgaatgtagaataatattccattgtatgcatataacacatttatggaaatatctgttcacccattggtagacatttggtttgtttccatcttttgactgttgtgaataatgctgatgtaaatattggcctacaaatatctgttcaagtctctgctttcagttttttttttttttttttttttttttaggtggagtctcactctgtcgcccaagctggagtgtagtggcgccatctcggctcactgcaaccaagctggatcatatggtggctctgtttttagttttttgagaaacattcaaacagcctcctgggttcaagtgattctcctgtctcagcctcccaagtagctgagattacaggcacatgccaccacgcctggctaatttttgtattttttgtggagacggggtttcgccatgttggccaggctggtctcgaactcctgacctcaagtgatccacccacctcggcctgtcaaagtgctgggattacaggcgcaggccaccacacccaaccagttcttttcattctattcccagaagtggaattgttggattgtatggatcataaatatacttccgtgtttgattttttgaggaactgccatattcttttccacagtggctgtttccacccagcaaagcgcaaaggttccaatttctccacattcttaacaacacctgttgttttttccttttttaataatagttatctgaatgggtatgaagtggtatcttatagttttttaaatttctttgagtacgtagtggctgcatatatttatggggtctgtgaggtactctgatagagccatacaatgtgtaataatcacatcagggtaaatgaagtatccattaccccaagcattgatgctttgtgttacaaacaatccatttatactcttttaattatttcaaaatgtacaataaatgatcgttgactgtagtcattcccaaaaagagaaaacagtggtaagcaaatgaatctcacagtaattaattaaatcaaaatgggtaatgatagaggggtggtttgtcatcatattcctttgtcctctgcattttctgaaagtttgcaagtgatccagatgcttaatcagactcaggttctgttcctttggcaagaccataggtaatgttccgttcttctaatgggaggcatataattttttttttttttttttttttttttttttttttttttgagatggaatctcgctctcttgcccaggctggagtacagtggctccatctctgctcactgcaacctctgcctcccaggttcaagcgattctcctgcctcagcctcccgagtagctgggattacaggtgtgtgccaccatgcccggctaacttttgtatttttagtagagatggggtttcaccatgttgggcaggctggtctcaaactcctgacctcaagtgatccacccgcctcagcctcccaaagtgctgggattacaggcgtgagccaccgcgcctggcctgaggcatgtaatttctgattatcttttgtaaagataacagtcattgatgttcaattctagatccattaattcataggggttttaaaattgtgatattctatcgttcttttttattcataactagaatacttttatacagagatgctcccatccatctattgtttactcagtgatacctttatatagggaaggcaggataaatgtttgatttttttctctttatttcctcaaatgtttgatttttccttcagttgcattagttcgttttcatgctgctgataaagacagacgtgaaactgggaacaaaaggaggtttaatggaacttaaaagttccacatggctgggaagcctcagaatcatggcgggaggcaaaaggcacttacttacacggcagcggcaggagaaaatgaggcaggaacaaaagtggaaacccctgataaacccgtaagatctcgtgagacttagtcactatcacgagaataacacggaaaaaccggcctccatgattgaattacctctccactgggtccctcccacagcgtgggggaattctggggaatacaattcacgttgagacttgaatggggacacaggcaaaccgtatcaccagtttacaagatagtgtattagttctctgtcatcttttttgggtgtgtgtcataaactcatgtagttcaatatatgtgatgaatttcagtctactgcagtcatctttatcaaagcttagattgcctcatctttggccattgggaacaaagatggttcctgagtctttgtgacctgaccttgatcatctttggtgaataaagggacagtgttttttgttttgcttttcaaaaacctcagcatattttctgtgcctttaggaaggtggattttagggatctatttgttttaggatatttggaactgattgatacgatctttgatataatttgtaagcagatatgccttagaagctgttttacttttaaagaataatagttttattttttagtttatgtggaaaatcaaaagatttcaataaaataagttccaaggactgattttaaacctaatttaatttttcttttagacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattaggtaagaatattgttttcttattttaaatttttggttttatgtgatcttttcgattttcccctttccctaaaatatttacctatatatatgctatctattcatatcagcagtttctgtatgtgctcttggatatattaacagtatttcctatgtccctccagtttctctctttatctttggctttgcagtacagatgctccctgacttactacagtgggattacatcccagtaaacccatctaagttgaaaatgcatttcccacataatccaccaaacattatagcctagcctagcctactttaaatgtgctcaaaacacttatcttaggctacagttgggcaaaatcttctaacacaaggcctattttataataaagtattgaatagctgatacaatttactagatagtgtagtaaagtgtggtttctactgaatgtgtattgcattcccaccatcataaagccaaaaaattttaagtcagctgttgttagttggggatgcctgtaattaacaaaccttactgagccatttgcctgaggagcttgcagcagtcttgtagcagtgcttctccaattacattttctaattagcttcattaaataagaataatagatctgaaattactttgtttcttgtgaccatgtatttttgcatattaagttccgaatgtatgaatgcatttattcaactagtctactccactttcacatcttaaaataactcttgttgttttatttcactataaaagttgcaaatgttcattgaatataatgtgcaaatgtggaaaaatataaaggaaattcatcaaaatgtatcttaattttataagtgatcttttccttctgtttttccaggcttttagtcaaatttttaaatgagttttcctcttatcatgaaacattctttaaaactatttttgtatgtaattattttgttgtacagtttatatactgttgaaaataaattttcctctgggatcttagtttcttccagtttttcaccatgataaaaataatattagtagagaattttgtatgtaaatgtttacttttctctttccttaagatagatgtctgggagtggaattgttactggattaaaaagtgtggcttatcatctcagtaaaagatcttacaaatggggagggaattggtcctaaggaataagaggttaaatttacatacgtaaagatcttatttatttttatcttgatagatgtgggttgtttttttttctttttcttttgagacagggttttactctcgttgcccaggctggagtgcaatggtgtgatcttggctcgccacaacctccatctcccgggttcaagccattctcctgcctcagcctcccgagtagctgggattacaggcacatgcctccacgcccggctaattttgtatttttagtagagacggggtttcgccatgttggccaggctggtctcgaacccctgacctccggtgatccacctgccttggcctcccagagtgctgggattacagacgtgagccactgcgcccagccgatagatgtgttttattattttacttttagttctgatttgcatgtttttgtataaataaaaattctttacctgtaacttagttggtgtgatctatgaaatcacaacttactgcttttttttccacagagctacattttcaccatttatgtgcatttgattataatattgtaatgatgagggaagtagattataagttttgtttataatcttcagaagtaaggaggatgatattatccaccttttaaaaaatcttttcctacctaaatgttactttaataaaataatactatgtttatgtagtacctcattatttacaaaggagttatattctgcaagagccctataagataggtagggagatactaagatcttcagtttacagatgagaaatctctgtaagatgcagattaagttcaacactgtgcctgtaaccataaagctgaccaccagtaaaacgaaggctagaactccagtaccctgtttgtttcttgcaagactcatatttgttattttactgagtatagcgtgagaaagagagaaaatttttcttcagtggtggactctgattcttctctctttctacttacccatttagtcggaaccaactgtcaacattgccggtacacttgtgtaatttgccattgaaagtcttaattgctagtaataacaaattggtgtcacttccagaagaaattggacaccttagacatttgatggaacttgtaagttaatatttttgattgtccaacatgtgtgtgtgtgtgtctgtgtgtgtgtgtgtatatatatatatatatatgaaaccttggagagagagatgtatacaaagtcataccatagtcttttatatggcaaagatttattattgatatatgtttttgacttattttccagtattggtaatgaatcatatactgaattttccgtactcaagtggttggcacacagaattaagaacggaaagtacaagcctaattggcccacacagatgggaaaaggtcattagaattaggttctaaccaatattaaatgatttctgtgtcattaaatttttgagatatgttaatataattgaatttttcaaaataaatttgtttgtatcatcaatattctgatttttgattagctcctgtaggggaatggcactacaaaggtcaggtttattttttgccttacattatatctttagacgctatctcccactctataaagtaaaatatacttcattgccatgtttgtttgtttgtttgtttgttttgagacagagtgttgctctgtcacctaggctggagtgcagtggcgcaatctcggcttactgcaagctttgcctcccaggttcacgccattctcctgcctcagcctcctgagtagctgggaccacaggcgcccgccaccatgcctggttaatttttttgtatttttagtagagacagggtttcaccgtgttagccaggatagtcttgatctcctgaccttgtgatctgcccacctcggcctcccaaagtgctgggattacaggcgtgagccaccgcgcacggccctgttgccctgtattttctaagacacttaattgaactccttcaccaaatcacttcttgagtatttaccttctgagcatgggaataacaattttctcatttaatcaccataataatattatgaattgattactaaaattattttcattttatagctgaggaagctagcactcaaataggttaaataacttgcctaaggttatataacagaaatagtatttgaaaccagactaccttaactctttctgaagtggtcaaatacaattatgtccattaggatttaggggtatggtttcgtgtaggtttattaacaaagatggaagatggttatcataaattaatacatatgtaatatagttggatcactttttccaggtagattatgaatataagaggttacgtgggagaatccacaaatatatttaaactagagtctacattctagaccactatttttggagccagttagaactaggacataaagatcagaatgtatgtttatcagcatctcttcagaacttgggttaaaaacatgaactagaagtaaactataattcaaattcttattttcaaatcatttaaacattttgtttctacttattcaatcctaaatacttaaaaggtagagatgtgttatagaagctgctttttgttttctacaaaagaggttaattgatatcctcagtcatataaggaacttgtggcagaataagaattagtgtcccagccaggcgcagtggctcacacttgtaatcctagcactttgggaggccgagaggggcagatcacctgaggtcaggagttcgagaccagcctgaccaacatagtgaaaccccatctctgctaaaaatacaaaaattagccaggcgtggtggcacgcacctgttatcccagcaacttgggaggctgaggcaggagaatcgcttgaacctgggaggcagaggttgcagtgagccgagatcacaccactgcactccagcctgggcaacagagtgagattccgtctgggaaaaaaaaaaaaaaagaaaaaagaatgagtgtccctaaagctctccattcccatctgatggttgttcagcaacatccttgttggttcgctctttttttcctcttcattaagtgaaagcaaactgctgttttcaacatacgtattttctgagagattatacattgctattaccttttggctcagactcgatttttctatgctttcaactttttttttttttctagctaggatttgaacctatatcctttcaacttcttttagaaccattttaatgcctagagcattggactcagaagtctagcttctggccgggcacggtggctcatgcctgtaatcgcagcactttgggaggctgaggcaggtggatcacctgaggtcaggagttcgagaccagcctggtcaacatgatgaaaccccatctctactaaaaatacaaaaattagctgggtgtggtggtgggtgcctgtaatcccagctacttgggaggctgaggcaggagaattgctggaacccgagagacggaggttacagtgagctgagatcgtgctattgcactccagctcgggtgacaacagtgagactccatctcaaaaaaaagaaaaaaaaaagtctagcttctgattctacttcaattattaattggtaggaaaagtaaaaatagtattttctctaaggatactttaaggaaattaacgtttgaggcttattgaaaaatttggcaagaggtctctttttattcttttttctttttaaaaaaaagaaaatagagacaaggccttaccatgttgcccacgctggtctgaaactcctgggctcacgtgatccacccacctcggcttcccagagtgctgggattacaggcatgagccaccatactccgcagcaagcggccttttctaaatagtaaatgtattgttttcttttagtcatattggaagaattttaagtgttaatgtggcagcttccctctgttcatataatgatgggtttacaaattattttggctgatctcagaattatggtattctgaatttattaatcttcgaacctgtaggtagtctcttttcagaaccattgaattaagctattaagtgagataccagaaggtctcccaaacatatctaattttatagacagtttaaagcagacaagtttgtaatgttaggacaatctttattttgtatcttttcgaaataggatgtgagctgcaatgaaattcaaactataccttcccaaattggtaacctggaggccttgagagaccttaatgtaagaagaaatcacctagtacatttgcctgaaggtaagaaactatgaaataagaaaccatgaaataattgttttattattttaaagctctctcagaccaatcaagacaaaaatgtataagggttacatctaggctgggcgctgtggctcctgcctgtaatgccaacactttgggaggccgatgagggaggattgcttgaacccaggaattcgagaccagcctgggcaatatagggagtctgtctctacagaaaattaacaaattagcccagggggctggcgcactcttgtagtcccagctactcaggaagctgaggtgggaggagtccctgagcccaggaggccaaggctgcagtgagctgtggtggggtcactgcactctagcctgagcaccagaaagagaccttttttaaaaaaacggggtggggagagagagagagagtgtgtgtgtgtctgtgtgtgtttgtgtgtgtgtgagagagtatgtgtgtgttacctccagtgtttgaaatctaatggtttatttaatagtgttatctgttccattgtggattttaaaagcctcttcaatgaaaaggtttgataactcttgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctac

SEQ ID NO: 452 - DNA, 5671 bp, Homo sapiens
gggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaa

SEQ ID NO: 453 - DNA, 60850 bp, Homo sapiens
ctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaact

SEQ ID NO: 454 - DNA, 70942 bp, Homo sapiens
atctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagcccc

SEQ ID NO: 455 - DNA, 32028 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggt

SEQ ID NO: 456 - DNA, 31628 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaact

SEQ ID NO: 457 - DNA, 73229 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattcc

SEQ ID NO: 458 - DNA, 31260 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgccc

SEQ ID NO: 459 - DNA, 31628 bp, Homo sapiens; identical to SEQ ID NO: 456

SEQ ID NO: 460 - DNA, 73258 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgagccgggattttgaggtttccggtggagcaggtgagcagtatttactcgcctgccctcctgggctggttatggtgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgtttctcaaactagtgtccataggaaccacctggggttttgttgaaaatacgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgctaaagtaagtaataatgactgtcctttctcacagggtgattgtgtggttaaagtgtcataatatatgtgaaaggacactggagactctacagtgctgtataaatgtcagttattaaagtaaccagtcagacattaactggccatagtgtgaaacaaatgtatagtagtaatagtggccacgcctgtaatcccagcactttgggaggctgagacgggtggatcatatgagatcaggagttcgagaccagcctggccaaaacagtgaaaccccatctctactaaaaatacaaaaaattagctgggcgtagtggcgggcgcctgtaatcccagctgcttgggaggctgaggccggagaatcgcttgagcctggaaggcggaggttgcggtgggccaagatcactgcgacagagtgagaccctgtctcaaaaaaaaacaagaacaaaaaacaaaactaatatatatggagttctagattatccaagcttataaaggcaagtgattgtgtaatcacaaactcattattgttaggcagtgaagtaaattcattggttgattgggctttctgtttacaagtttgtatttgcataagtggacttacgtttctgcttatattttgccatggttaaaatcaaaagaaacatagcctagaagcattttgatgccttaggataaagcaggctaagattaagttaaattttaaaacattattcatgtacctgttgttacagagagcccactttacagttgcaaataaagttaaaacattttcattcatttaacttacttgaattacaatggtagagatgtcctcatttgaaacaagaaaggaaaataatcatgttttttatattgcagtcggaaataatgctaacaagaaaaaaattatggctgtaaatactgaaagaaaaatttacatttagaaattaataaaggtacaaaaatgttgaaaatttaattaactaaaaataatcccttccttaataaatactattttgaagtcctaaaaactttgtaaatatagtagatcagattatcttgcatgaattgacataaaacatgagaaaatagaaaggatcaagaaaattaaagctgggctggtggcttacgcctgtaatcccagcactttgtgaggccaaggtggaacgatcacttgagcccaggagtttgagaccagcctggataacatagggtgacccagtctctacaaaaataataaaacaattagctgagcatggtggtacacgcctatggtcccagctacttgggaggctgaggtgggaggattgcctcagcctgggaggttgaggctgcagtgagctgtgattgtgccactatactcaagcctgtgatggagcaagaccctgtctcagagaaaattactagtaaatgggcaattaatctaccaatctgaataatggtggtgtgccagggtcttattacatgaatttttcagtgaggccacgttattataataacttgagagtaaggggttaattagaatgtattgatgaataaacataattaacagattttatatatatgtacttaatattgtatctatgttttcatgtatctttaattttgttacagaatattataacttgccaaagacactggctctagtacagtgtataccattttattagttttattaaattgtaaatgctacggtccagattttatattcagaatgctcatttacatattctgcctggaccaagtaatttggagcccaggtcaaccaaatgttattttacattgtttgcacaaaaatcaaattgatttctatacttaacaattcagaatctcattaagtcaaattaatatggtttaagaaagtgtactttatttcatgctaagatgtcattttggccttaataaggcttttggcatgtaatgaagcatgcacaaatctttgagataaaaatagagcatttttccacacaaaaacatatatatacacaaatgttcagagtagggctattctactttttagtagaaacaactcaaatgtccatcagctgatgaatggataaagaagatgtgatatatgtgtataatggaatattattattattataaggaacaaagtactaatacatgttacaaaatgtatcttgaagccttaaaacattctgtcaagtgaaagagccagacacaaaaggccacatactgtttgattctgtttatgtgaaatgaccacaatagtgcattctgtcttccaaaaagctggtttacttacaaacacaggttaaaaaaatatatatttgtaatactgcttttggtgtagggtgaggcacgataaagagactttcattcggtttgtcaatcagtgatacttaggtctgaataggcaagtgggagtctttcaggtttaggacaaagaatgttaatgtagtagagatctgttgatagagtcactcctagttttctatttatttaaaaaacatcgaattactattaggtgctagacactgaagatacataaaagacacagatgtcatctataagaaagtctcttgaggagaccagtaagcatcagacaacatcatagagtgggttcagtgacataaatgtgtgcacagagcactattaatgtactgaactcagctggcggtggtcagggaaagtttctctgaggaagagagttgtattaaaacaaatgaaaaaaagggagcaaggcaaagttggaaaaaaattgtgagggaggctcctaggcagaggaaacagcatgcaaagtctcagagatgacttgataagtttttaaaactagaaaaactttggctgcagtattgcgaggttgaggtggcggggggagcggcaaggagagaatgagaagacagaaaagatgaggagacaagatagatttgaaagacatgactggagatcttgagggccttttattttgaaggggatgggatagaatggagaaattgaatttttaacaaaaatggcctgatcagatttgatggcaaaaaggtaactgtgatagcaatgttgaagcatgtgcccaaagtatgtattgggatggagactagaggcaagaaaaacaggatgttaatgaaataatcctgaagaaatgggagaaagatctgaaatagttgcactaataagagagagtacaggaagtaaacttagtttatttactgggtcaagcttgcctaaaaaatatttgggggcggggggaattctccctccagttacctttattagaatgttacaataaaatcaagccaggcacagtggcttatgcctgtaattccagcactttgggaggccaaagcaggaggattgcttgagtccaagagtttgagatcagcctgtgcaacatgatgaaactgtgtctctacaaaaaaattaggcatagtggcatgtgcctgtggtcccagctgctctggaagctgaggtgggaggatcccttgagcccagaaggtcaaggttgcagtgagccatgttgcagcagtgcactctagcctaggtgacagagtgagaccctgtctctcaaaaaaaaaaaaaaaaagtttatagaaaaacaaaatatgatattctaataaaataacttgaaacaatagtatgaacttcctatgtttttagctcttaaagaactacgaaactaaagtttacataacattggaaacatgtgctacatgtttttttttttttgcaaatcaaatctcctcttgaaactcaaatgtaggactaactgccacaatttcatttcttttaaatttggccatgtctgtactaactgctgtgatccatgtctcagttctcttaccactttactagaacctttgggagacttttgttcattctttgactgatatcatttggctttcaagtggccagaaaaaagaattcattatctatttctgttccatctgcctcagacaaaatactattatgtgttgccaacaagatcataaacctaaataaaacacaggttctaaaatcacatggcagtacttagtataagtgggtatcaaggtgactgggactgtgcttacagtaattatagattactaaaatcacaaaatggaaaaaagttcatgtagagaattcaaagaatttagtttgatgtagatagagattataacaatccttttgtcacatacctaaagtggaatttgttgagtttgaccttgtgacttttgagtcaagaaatgctaggcaggtagaacagataaattaataaacctgattctgaaatggaagtaaaagggctttaaagatgttagaagcattttaagattcattctcattctggatctcaggacataatttcttatagaaaagtagttgtgcctgcagatcaatccacaaaaggctttaaaacccaccctccctgtatatattacacctatgagaaaatgctccatagaattccaaattgataacaggaggaccgacctacccctctgcccgccagaattcccgtggctcagggcaagtactgaagccgaataggaagaattgactgagggtaaatcatgttgagtggttggttgaaagctttgaaaagttggagaatggtggttaagaaatctgtacattcagacttcttgaatgtcactgtatgttttgggttagtgctgggatacttttcttttttagtgccagatccattaatttacattcctctccactgccattatcaattgcttcctaacagaaaccagtaagctttctttttcccccttttctacagagaagagcagtttcacaagattcaacttttcttatacttttgttcctaaaacagatacacactctgttaagttttcataagggtttttatttctgcaagtatgactttagtgtttatatatgattataagcaggcagctagcagggaaaccatgggtaaaggattaaaaaactctcatttgatcctggtttccctcctaccaccacttcagcccccaatccctgcctaacaaattagacccaatagaaaaagtcacaagattgagggccgggtgtggtggtacatagctgtaatcccagcactttgggaggtcaaggcagggtggattgcttaaacccaggagttagagaccatcttgggcaacatggcaaaaccctgtctgtacagaaaataaaaaatcagcatggcgtggtggtatgcaccagtagtcccacatactagggaggctgaggtgggaggattacttgggcccaggaggtcaaggctgcagtgagctgtgatcaggccactgccctccagcctggatgacagagtgagaccctgtctggaaaaaaaaaaaagattcaactttttttttttttgtcttttgtttgttttgagacagggtctctctgttacccaagttggagtgcagtggcaccatcttggctcactgaagcctctgcctccagggctcaaggagtcctcccacctcagcctcctgagtagctgggactataggcatatgccactaggcccagctaatttttgaacttgcccacacagattctttccccttttccatccatctccaatccccactctctcaggataccctgatggctctgtgggtatccttagtgttcacttatcacagtctacagaaccaccagtctaatgaatataaaatattttaaattataatgaagaagcctcattatgagtaatagtaacatgtgaagcaaatacaatcagccctccagatctgtgagttccacatccatggattcaaccaaccacggatccaaaatacacatttttaattgcatattttctgaacatacatacttttttcttgttactgttccctagacaatacagtatatttacagtgtttacattgtactaagtattataagcaatctaaggaggatgtgtataagttatatgcaaatattatggcattttatatcatggatttaagcatccttggattttggtatctgagagtggttctggaaacaatccctcatggatactggaggatgactataatatgaagtatattagagataaacatataaagacaggcactcagaggagtggcttaccagcagacatgtaataaaaacatgagaatttcagttgcctgacatctctgtaagccagagatatgtgctttttggctgcccaaagaaactatttcagtttaaccctgaaagaaaggaactatgttgtctagcataaagcagttacctcttcctcatctctaccagttagaccacagctacattgttatgtttttaacagctttattgaaatataattgacatacaataaattatacatacctaaataaacagtttgataagctaacatatatatatatacccatgaagctcaccaaaatcaagataatgaacttcaccacaagtttccttatgctcttttataaatcctttctcttgttcttcccccacccctctgtcttcttaacccacaggacacctctgatctattttctgtcacggtaaattagtttgcattttctagagctgtattgaagttgaatcacaatacaacttcttgtctgccttttttcacttagcataattattttgagacttacctatattgttgtctctcagtagttcattatcttttattgctaaataatattccattgtatgtatttgccacaatttatccattcaccagtcagtggacatttggtttgtttccatttttttttttttttttttttttgagactgagtctcactctgtcacccaggctggagtgcagtggcgcaatcttggcttactgtaacctctgcctcctgggttcaaatgattctcctgtctcagcctcctgagtagctgggactataggcactcgccaccacgccggctaatttttttattttttagtagagacggggtttcaccatgttggccaggctggtctcgaactcctgacctcaggtgatccactcagctcagcctcccaaagtgctgggattataagagtgaggcactccgcctagcctcttccaatttttgtcttattacaaatagggctactacgaacattctttacagtgtttatatggacatatgttttcatttctcttgagtaagtagcttaggagtggaatagctagattatatggtagatatgtgtttaactttttaagaaactgccaaactttcccaagtgttttttaccactttatggtcccacaagctatgtatgagtgttccaatttctcctgactggttaggattagtcttttcaattttagccattgtaataggtgtgtagtggtatttcattgtcattttaatttgcattttcctagtgaccaatgatattggcattttttcatgtgcttctttgtcatccacatatcttctttgctgaaatgcctgtctgtatttttccccattgttcattgtattccttttgtcagtatttatttataggtgacacatatgggagtggccttaaatgttttttaactaataaagtcataacaaggtaacatatacctggaggaatatgaaaaagcatgacaaactttactttgcgagatagcaaaatttaagatttcactatataaatctgagtactaggtcaattttttttgtgggtttttgggtgaaacctgctagacagattctaaaagagcagtcacactatgtctattttttaaattattagctagcagaaccacctcaactcacattgactagtccctaagtcacttccacaattaagagtataggcagtagtgtgatagaactggcttgtaacagcttacaagggtcaatttaaaaattgtaggaattttgcaggctgattgttaaacacagccattattaaaaattatagaaactgacaattatattaaaatctgttaaataaagctcaataataaatactcaaaactcacttcctagttattttactatagacatacctaattttattgaacttcatggatatggtatattttacaagttgtaagtttgtggcagcccatattgtgcaagtttgtggtgccatttttccaacagcatgtgcctactttgttagtatgttttagcaataaagtattttttaattaaagtatgtacacaggccaggtgcaatggctcatgcctgtaatcccagcattttgggaggctgaggtgggaggatcgcttgggcccaggagtttgagacaagcttaggcaacacagtgatcctgtctctacaaaaaatttttcggctgggcgcagtggctcacgcctgtaatcccagcactttgggaggccaaggcgggcggatcacgaggtcaggagatcgagaccatcctggctaacatggtgaaaacccatctctactaaaaatacaaaaaaattagccaggcgtggtggcaggcacctgtagtcccagctactccggagaggctgaggcagaagaatggtgtgaacccgggaggcggagcttgcagtgagccgagattgcgccactgcactcaagcctgggtgacagagtgagactctgtctcaaaaaatatatacatatttttctaaaattttctaaaatagctgtagtctcagctatttgggaggctgaggtgggaggactgctgaaacctgggaggttgaggctgctgtgagccatggtcttgctgctgcactcctacctggtgacagagcaagactctgtctcaaaaaaaactgtgtacacttgttttagacataatgctattgcacatttaaatagtgtaaacataactttcatatgcactaggaaatggaaaaattcacgcgaactaaacccacagtatctctgaggtatgctataccttttactgtgttccgtgtttttgtggttatgtctattgtatctgcatggtggaagtattacagtttgatagtgtgcacctcttcccagctctgtgttcagtgatgttctttggaacatgacacagtaccacataggagtactttccccagggaaatttgaaaacaccacagatcagatctctgcctgctgctccctacttcaggctagttgttaaactttaccagcacacttgtgatgacatgacccttcaagttgactgacttctgtcagtaatgaataatcgaggcatcagttagatggagagtttacctttgtgaaacacttaactctcaaaaagaaatatttttgttacagaataaagcttgtaacacctagttttcttggtgttcaatgttttccttacttccaaattctctaaggtagagaaaggtaaagtctgactactggataaggggggatactaatacagtagttctgtggtctcaagtaaaagcgtaaaatattacatttgaagtagaactagaaaggatgctaaacaaaactgtgctgggcaaaaaaaaaaaaaaaaaaaaaaagaggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagttcagacacaaatgtaagacctgaagctataaaactactagaagaaaacaggtaaaccacttcaggacattgggtctaggcaaagattttatggctaagacctcaaaagcacaaacagcaaagacaaaaatagccaaattggactatattaaactaaaaagctcagcaaaggaaacagcagagtgaagagataacctgttgtatggaagaaaatatttacaaactattaatccaacaagggactaatgttgagagtatacaaggaacttaaaagtaaaacaaaaataaccccattaaaagtggtcaagcgatgtgaatagacatttctcagaagaagacacaaatgcccaataagtatatgaaaaatgtgtaatatcactaatcatcagaaagatgcaaatgaaaaccacagtaaggtatcacctatgacagagtggttattacgaaaataacagatgctggtaaggatgcagaagaaattcttttatactgtcagtgggattgtaaattaatacagcctctatggaaacacagtatttctcaaaaaactaaaagaactgccatatgatctgtcaatcccactaatgggtatttattcaaaggaaaagaaatcagttcaatgcagcactattcacagtggcaaagaacagaatcaacttacgtgtccgtcaacagatgaatggataaagaaaatgtgttacctatgcacaatgaatactattggccacaaaaaagaatgaaatcatttcctctgcagaaacatggaaggtactggagattattgtgttaagttaaataagccaggcacagaatgacaaatatcacatgttctctcattcatgtggaagctaaacatgttgatctcatggaggcagagagtagaatgatggttaccagaagctgggaaaggtgtctgggtgggaggggggatgaagagacgttggtgaatgggtacaaacatacagtgagatatggaacaaaggaatgtttaatagcagagtagggtaactatagctagtaacagtgaatgctttttgtattttaaaatagctaggagagaagacttgaaatgttcccagcacttagaaatgagaaatattcgaggtgatggataccccagtcaaggtaacaaaatagcccatatacctcataaatatgtaaactattatatatcgatttttttaaaagtatagcagtttgttacaaaaattagctgggcacggtggcaggcgcctgtagtcccagctactcaggaggctgaggcaggagaatcgcttgaacccaggaggcagaggttgctgcagtgagctgagatcatgccactgcactccagtctgggtgacagaacaagactcttttaaaaaaaaaaaaaagtatagcaatttggtattaaactggaaggaccaaaggacctaacaaataatctttaaaccagtcaatgccctatgtaacttgtttaccaataaattggacagaacagatggaactttagtgatacaggtggtttatttttaaatgaggagggaatacaaattccccaggagataacctctttctctaagaacataaagttttatgtaggagacagaacattctcatatgaaaaatacctaagaatatatgaaactaatatatgtaataggaagctattacatatattaatggtaacttagttgttcagtttttagttactgctgaacatcttgactatttaaataaatcactattttttccctaaccttgtccagatttctaaaactcagttactctcctaaccagtctacttaagtgaatatatttttccagtcatcaagactaagattcagtataatggagtcatctttgtctttcacccttccctttccttatgagtgtccatttctacttatttaggccttcaatgcatattacaccttaaattgtataacagtttatacattttaaaagattttcatcattatgtaatccctctgagttaagcagaagtgattaacatttcatcactcaagtatttattgagggcctacaaggtcactacaaggtgagtgacatataaataaggatgcagaatcaggcaggtcaaatgacttgcccaaggtgacaggatcagtgattattaccagtcttatgattctaatatcagcattcttttcattacactatgatgcctctcaactcatatttggtccattactataaattcatagtgggcttctctgcctctacttttccttctccagactatcttgcacatcaccattaaattaaacacagctttcattataatgtagcacaataaagaacttttcaatggtttcctattgtatagaggagaaaaactttatctctactttttacaggatatctctattaaactgtgatcctcatattcttttgaacatacttttacttttctaagagtatgcctttgcttttagcagtttaaccttctttgagtttcaagtccctaagtaatagttattaccgtagatctagatatttatgtaccaagcattatctatagactacatatatgcacaactaccttgtgtattttgactgagggagtaaagttttgatactaaaaaaaaaaaaaaaagagtcctctttgctgggtgaggtgcctcatgcctgtaatcccattgctttgggatgccaaagcaggagaatcacttgagaccaggagtttgagaccagcctgggcaacatagtgggaacctgtttctaccaaaacaaaaaacaaacaaacgctgggcatggtggtgcatgcctgtaatctcagctactcaaggaggctgaggtaggagaatcaattgaggccaggagttcaaagttgcagtgagctatgatgaggccagtgcactctagcctgagtgacagaaagcctgtcttaaaaaaaaaaaaacctcgagtttcacttctgataattaagaactcagtggttttgatcatacttctgctgtgaacaattaaaaaagctagaccaaaaccaaacaaacacccctgtttaaaggcacttgttagtgacaagttgtattttccactatcacaacaaagaaaaaggcaaaatatgtggcaggcgtctttagatttggagacaacaaaacatagtacaattgggtaagctgttcttagaggcttaactgtaactgtaagactaccagttttggccaggcgtggtggctcacgcctgtaatcccagcacttcgggaggctgaggtgggtggatcacctgaggtcactaaaaatacaaaaattagctggaagtggtggtgcatgcttgtaatcccagctactcaggaggctgaggcaggagaatcgcttgaacctgggaggcagaggttgcagtgagccgagatcttgccactgcactccagcgtgggcaacagaataagactccgtctcaaaattaccagttttgagtggggtagggcccagacttaggctttatgatcctgtagacccaatgatattagaagttaatgtaggagagatgttatatgaagcctctggcaagtttcagtgcaagaattacaacatagacccttaaggtttaggagtaaggccatatcttccttagccatgattttgtttcatttttttttttttatttgaaaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagagtcctggaagtttttcaaggttcatcttgcaccttctagcatgcatatgtcgtaccaaagcatgtagaatgctgcctacttctgctcttcagtttcatttaatataatttcattactctgataaatcagtgtgatgttctatggaataacaaaagaccgtcaaggtcccttcataccatatagagaacaggagagttgatgtagcctgagacaagacagtaaggacttactgttatccctcctatttaaacgtagtctgtttctgattctccttagaatgggggtggggggacatttccagatcaatatcagatcagtatcgtgtcaacatgggtattaatttcttccgaagaagataccacacctagaacagcaaccataattggcatccctacctaattaaagtttgcagtccactgtcattcttcactagccatctggtttttatattgtcattctctatgatgcatctggtggccacaggaaatttaaatgggaatgtggtatgaatcaccatggcagcatggtggcactaatctctgcaattcttttggtttttctattttgcttttttatgttttgtagaaatgcagtcttgccatgttatataggctggtctcaaactcctggtgtcaagcaatcctcctgccttggtccccctaagtgctggggttacaggcatgagccactgtgcctggccaatctctgcaatttcctcagggatatagccctgcttttcctttactatcttaatgaggagtggtagaaagcagacctaagctgctgtgtagcactttctaccataatagcaatccctccattgatcaggaaaccaaaataaagattgttgttaaaagatacatattaccactacacatctgggactggagaaatagccacagtatgggtccttctggatctactgttagccacagccaggccaagattccatcacttgacttccttaggttccctattctgaccagttgtccagggtagagttttgggtttctagtattagtacaagttaagagacagtgccttaagaattctagccagcctgggccgggcggtgggtcacacctgtaatctcagcactttgggaggccgaggtgggtggatcacgaggtcagcagatcgagaccatcctggataacatggtgaaaccctgtctctactaaaaatacaaaaaaatttacctaggcatggtggtgggcgcctgtagtcccagctacttgggaggctgaggcaggagaatggcgtgaacctgggaggcggggcttgcagtgagccgagatcgcgccactgcactccagcctgggcgacagagcaagattccatctcaaaaaaaaaaaaaaaaagaattctacccagcctggccaatatgacgaaaccccatctctaccaaaaacacagaaactagctgggagtgatggtgcatgcctgcagtcccagctatttgggaggtagaggttgcagtgagctgagattatgccactgcactccagcctgggtgacaacagagcaagaccttgtctcaaaaacaaaacaaaacaaaacaaagaattttggatattttcctttctctagtgaatggtcactggtccctatggaaaaggcttagggcaatgattcccccaacatatctgctcactggaagtatctggggaacttgaaaaaatactgatgcctgggtcttccctgagattactatttaattagtttgggttgtggcctgggctttagaatcctaaggtgttctaatgtacagacaagtttgagaaccccactggattagggaacaattcgttgtatacagctgtgattgcattgcccctttcgtcaaaggatccagtctctttccatcagtgaaggagtaccaagtctgggagctagatgagatgcttcaaattttactacaaaaccacaagaatttttccacctatatatgtcaagcagcaccttggtaggttactttattatatttccagggacctcatgatcatttagccattatcacttttccctgtgggtcaaactactctggttaacgttctctcctttgacttattttggtaattgtgcctactttgtctctgatatttatttatttatatttttatgttttttgagacagagtcttgctctgttgcccaggctgagtgcagtggtgtgatctcggctcactgcaacctccacttcccaggctcaagccattctcttgcctcagtctcctgagtagctgagaccacaggcatgcaccatcacacccagctaatttttgtatttttactagagatggggtttcaccctgttggccaggctggtctcggactcctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatcctaccaaattattaatgccaaaatattaactcttgattcttaggtgagtgcacccatgccaataaatttgccatgatctaaccttaaatgtattctcatatatgctgtccaagtttctgctgattaaaatggcaaggcctttagttctcctacataggttttctctctccagagaaggcctcaattctctgactaggctatgttgggatataactggaggcactaataggtagtagggtaaattctttattttattatttttggagacagggagggtcttgctttgttcagactggagtgcagtggtgtgatcatggctcattgcaactttgaactcctgggctcaagtgatcctcccacctcaaccttctgagtagctgggactacaggcgcaaaccaccatgcatggctaattaaatttttttttttttttagagacagagccttgctgtgttgcctaggctagtcttgaactcctgggctcaagcagtcctcccacctcagcctcccaaagggctgggattacaggcatgagctaccatgcctagccccagccggtaaattctgaggagagcatgtatcagcttgtgaaggagcttgcccaagtgcaatcactgaaagcctctatgcataggagcctggtttcctcagaaagagatttaggggaagattgatgttcagagttttcagcttcatttttctctgctcaaatgtccctatcgtatgtcttaggactcctctccccaccaatgttccagcattagaataggaaaggggaagaattaagcatgtaattgatactacaaatctaccatatctgcccagtgattacagaagataatcaactccttcagacctgtaatagagttctcatgctccacatacagtcattttctttttgttgttgtttatgatagtgtctcactccgtcgcccaggctggagtgcagttgtgcaatcaaggctcactgcaacctccacctcccaggttcaagcgattctcatgcctcagcctcccaagtagctaggactacaggtgtgcgccaccacacccagctaatttttgtattttttcatagagatggggttttaccatgttagtcaggctggtcttgaactcctggcctcaagtgatctacccacctcagcctcccaaagtgctgggattacaggtgtgagccaccgcacctggtcaccacatacagtcttaattgtagtttttatgtttttctttttcttatgtatttttcttttcttttcttttcgttagagatagggtcccactctatcacccaggctggagtgcagtggcatgatcatagcttacggcagcctcaaactcctgggcttagacaaccctcctgcctcagcctcctgagttgctgggataacaggtgtgtgccaccatgcgcagctaattaaaaaaaaatttttttagagatggggtcttgcagtgttgcccaggctggcctcaaactcctggcttcaagagatcctcccaccgtagcctcccaaataggggactacaggtattagccaccatgccccttaacccacgtatgcctagcgttccattattggaacgctaagcatgtgggaattatttatagcctactgctcaaggtcatcgccaaggtctgatttttcactcatgcaaaaattcaaaaaattgcaacctctggcacaaacgggttaagtactttctgtttcggaccataagaaaagccagatggatctataatctttataattaccatggttatcatggtgatacactcctcacctgcttcacttgatttcatgttgttactggtaatcctaatacaactgcaaactggctgggcacagtgactccttcctgtaatcccagcactttgggaggcaaaggcaggaggatcattggagctcaggagttcaagaccagcctggacaatatagtgagactctgtctctacaaaaaaagaaaaataggccgggcatggtggctcacacctgtaatcctagcactttgggaggccgaggtgggtgggtcacctgaggtcaggagttcaagaccagcctcgccaacgtggtgaaactctatctctactaaaaatacaaaaattagctgggcgtggtggtgggtgcctgttatcccagttactggggaggctgagacaggagaatcgcatgaacctgggaggcggaggatgcagtgagccgagatcacaccattgcactcaagcctgggtgacaagagcgaaactccatctcataaatgaataaaaaataaataaataggctgggtatggtagtgcacgcctatagtcccagctatttaggaggctgaggcaggaggattgcttgagcctaggaggttgaggctgcagtgagctatggtcgcaccactgcactccattctgggcaatagagtgagaccttgtctcaaaaaaaagtaaactaaatattgtaagccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtcttaagaagaaatagaggacagattaaaaataatttaagaaggcttggcatggtggctcatgcatgtaatcccagcactttgagaagctgaggcaagaggatggcttgagcccaggagtttgagactagccgggacaacatggcaaaaccccacttctacaaaaaaaaaactagctgggtgtggtggcacacacctgtagtcccaggtacttgggaggctaaggtaggaggatcgcctgagcccaggaggttgaggctgcagtgagccctggttgtgccactacactgcaacttgggtgacagagtgagacccctgtctcaaaaaaaaaaaaaaaaaaaaaaggaaatatactggtaaaatgtattacattaataattttgtttatcaaggcaccattacaaaaagactaaccacaatgtaagaaaagatactggccacacatatatttgaccaagaactcatatccagaatatataaatgattcctaaaaatcagtaagaaaaagaatgacaacccaacagaaatatgggcaagtgactttaacaggcactacagaaaagatctccaaaatgtctctgaaggccatttttgtcaaaaacaaaaacatctccaaatgttaagtaccataaaatggtgctcaacttcaatggtcatcaagtaaaaggttaatgtcaaaatgagataccactacattcgcatcagaatgaccaaattaaaaagattgacaataccacgtgttgaccacagtgtggagaaagtgaaactttgtcacactgttgtggagcagtgacaggggacgggggacagggattgggtaaagtttccataaacttggaaaactgtcattctttacaaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgtgtaatttgtgagattgttacaatatttgccctcaataaatcatgcctactttgttcatgcatctttgcaatgtgcttttgccacttttcccatcaaaggctttatttccttaccccttgaatctagctatctttgtgacttgctttgaccacagaatgcaaatagatgtgactttgtacaacttcttagactaggtctagagaagcttcacagcttttttcaccgtttggaacactgcactgagaccactatgttataaatctgggagtgaaagacagtgtaaaggcagccacaggagtgaacacaggggagactaacagaactttctggccaaatcacagtgtggtgagagagaataaatcatgttgttttaagccactgttttggaatgcatgtgtaatgcagaagtagataatttgtaggaaacagagtcccttttccattacctagctcacctatttactctgttgtggcagagaatacaattatttcccaatgtcctttctcctcttcttcctttaatattagaacccccatttttttttgttttgttttgttttttgtttttttttttgagacggagtcttgctctgtctcccaggctggagtgcaatggtgtgatctcagctcactgcaacctctgctgcctgggttcaagcaattctcctgtctcagcctcccaagtagctgggactacaggtgcacgccaccacacctggctaatttttttgtatttttagtagagacggggtttcacagtattggtcaggctggtctcgaactcctgaccctcaggtgatccacccacctcagcctcccaaagtgctgggattacaggcgtgagccaccgtgcccggcagaacccccatatgttagctgggtacattgctacatggatagtgactataatttcctaactctcttgaaagtttggccatgtaactaggttttggcccatgggtcgtaagtggaaatggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattggtgtattttgttttacagattgagatcctgcacttttctccatctttttctcatttagcaatatctggaaatgacaactcatacaacttgaattcattccttttgatagctgtataatattttataggatgcaggagttgtaattcattctgctgttttcctactgattagctttcattttgttacccttttttccactatgaatatttttgtgaatagaaccttatgtatttctatagaacagattcccaagaatggtacagcaaggacaaaagatatctgtagcttaaaaaattttaatacaggttgtcagactgttttacgaataagttgaaaaatttcacatttatgccagctatctataacaatacccttttacttggacccctcaccagccatagttgctattggtcatttaacatttttcccagtctgaaaagatgtttcacctcacttgtgacaagagaaatgcatagtaaaattttactgagattaaacatttctgcttattagtcccaaatccaacagtttgaataacatactctaataacaatgctgtgggggcactctcatctgtttatacagcacctatggagagaaatttggcaatatctgtcaaaattacacacaaacacacacatctttttttttttttttttttttttttttttttttgagacggagtctcgctctgtcgcccaggctggagtgcagtggcgggatctcggctcattgcaagctccgcctcccgggttcacgccattctcctgcctcagcctcccgagtagctgggactacaggcgcccgccactacacacacatctttaacttagcaatctcttttctgtgaatttatccagcagatatcttgaacatgagacaaaattatgtacattattattcaatgatactgtttttaaaagctgaagactgaaaacaatgtccatgtccatcataaggtctagtaaaataagttctggcattcatgtagtggaatactaagcagccattaaaagataaggaatctcattatggagttacataaataattctaagatatattgtaaactaatatatgtaggacagtgtatatattgttatctttatttttaaaatggagaataatataaatttgtatttttctgtaaaatatctgggaaggtatgcaaaaaactaataaaagtattaatgggataggtggtggtgttatgagaaattggtgaacaggagatcatgggagactgaaacgcaaaacatctgtctctctctacacatacagtatctgaatgaactatctattcaaaaaggaaagaaaaatagctcctatagagtgaattcaatttcgcctactgtgagttttatgatcctcactttcatcaactgaataaaagggataagatccacttcaaagtactttctgaacactaaattagaggtgtgcttagctcagtgtctgtccatattaggcactcagtaaatgttagttgaattaaaaaaaaattgtcagtctgttagactaactggcatcttattattttaattttcattttcctgatttctcctgattctgagcctcttttcatatttggatttattattctctgaattcatattatttgcccatccattcttctgttgaattgcttgttcccttgatgtgaatttctgagttccctgattaaacctccttgcaaatatttttctaaatttgttgtgtatctattaatttcgtttagattttttttgcaaacaaatgttatttttatattgacaaatgtgtatattttttaaggataatgtatattctgctgttcttacatgaagtattctataaatgtcaactagatccagtagattaatgatactacagttcaatttttactgattttctgcctgctggatgaattattgaaagagagatattgaagtctctgtgatactggatttgtctatttctcttcgtggttctatcagtttttgccttacacattttaatgctgttaggtgcatatatgttaaagattgttttatctttttggagaatttacctctatacttatgtaatgcttctctctatccctgacagttttcctttttctgaaatctgctttgtctgacaatatagcaactccagctttctttttattagttttagcatggcagatctttctttatttacttttcacctatctatgtctttatatttaaagtgagtttcttacatatggttcctgaaaaaatgaaaaactagtaaaggctgttgtcttcctccctccaaatcaaccctgagtaacaacagaaacaagaaggaagcaaaagcttgaggaataagatcaaaaacttaagaggaaaccatagttagtgttaggagtaagttctgaaatactgttttgccatgccccactttgctttgggacaatcagtgccaaactactgattgctacagaaatcaccagcaacagatcaggcttcctgtaggattagataaagggtctgttgaagtgagttgccaatgaaaaagtggggctgaccagatactatagaatattggggcattcacccctccactccttccctgctgccagaattttgataaattataacagccttctgctgctggattgtggatttcaacacagatccttactagagaaacagtagcaaagagagagcatcagttctgtggttgcctacagctcttgctttctgctccttaaacttgtgggaagggataaaaacgagggtctgccattttgctctacctttctatccattattagaaggggtagtagataacactaggagaacatggcttgtgaaccaaaatatctagacacctgaggagtatgatcactatcaaacacaacaaattctacaacatgtaccaacagaagtagaataataggatataccaatacttttaataactcaattattcattcaacacaatttgtaaagatacagggtctcactctgttgcccaagctggagcaatcatagttcacttcatgcagccttgaactcttgggctcaagcaatcctcctgcctcagccttcttgctagctgggattacaggtgtgtgccaccacacccacctaatttttagaatattgtttatagagacgaggtcttgcaacgtttcccaggctgcttcaaacacctggcctcaagcaatcatcctgccttggcctcctgaagtgctgtgattacaagcatgagccattgtgcccagttcattcagcagttttttactgaacacctaccaagtgtcaggtactaaggattcatcagtcaacaagataggtaaataattttgttcatgtgggacatggcaagggggacagagacaaaaagatacaaattaactaaataataaacaattttggaaggtaatatttactaccaaaacaatgcagagtaggtagattgggactgatgaaagggttgccattttaaaatgaaacccatcctaaaataggagccacaaagatgcagggttgcggtgaggctggtaatatgtgaagagtgaacaagaaaccataaagccatatgagattattaggtgtggaaaaatatgagctaaaataaggatcatagctgggcatggtggctcatgcctgtactcccagcattgtgaaaggcctaggcaggcaaatcacttaaggccaggagttcaagaccagcctcgctaacatggcaaaactctgtctctactaaaaatacaaaaattagccaggcatggtggcacaagcctgtgatcccagctactcggaaggctgaggcaccaaaaatttcttgcaactgggaggcagaggctgcagtgagctgagattgcgccactgcactcccgtctgggcaacagagcaagacggtctcaaaaataataatgaataaaaaattaaaaaataaagaacatcatagataaatagcaggtggattggatcttatgatgcttttgagatacagaattttaatatttttgtgcagttaaaatctctagaacttttcctttgtgctttctagtgctttcatgctttgaaaaaacctttttatccagagatatttttaggttgataattaaaatatttaaaatcataatattcgtatatggaaagaaattcaaacaaaataagatactagaaagtaaaaggcctcatctactgtctctcctcctttcctcagaagttatcatttttctaggtatccttctagaaatgttctatgtataatcaaatacatgtaatttttaaaatttataaataggatactatacatactttctacaatttgcttttttcattcacacatatggccctactccagagattgaggttttaaatatcaggaagaattttatttagaaggcaaaactacagagacaaaagataattggttacccaggggtataagttaggtaggggtaaataggtggagcatagggcacttatagggtaataaaatgattatgtatgctactattatggtggacacatgacactatgcagttgtcaaaattgatagaactatacagcacagagtgacccctaatgttaactatggattttagttaataatgtagcagtactggttcatcagttgtgacaaatgtaccacactaatgcaggatattaataggagaaatggtgtgtgttgggttagagggtgacatatgggaatctgtattttctgccctgttcttctgtaaatttaaagctattctttaaaaagtctttgaaaaaacttcatttagaaaaactattcttaaagctttgtatagaatattttaaagttggaggctagaggtcacatatctggtagactgttgctatggcccaaacataaaataataaaggactatactatggtagcaaataaaattactttgaataggtttgctaatacctaagaaaatttcacattagaaattgagtggaatttaaagtttctaatataaagaaatcatgtgtcaaacatagtgttaatcaaaaataggaaaaaacaatatgcataaaaattatgagaacaaaaggaaatgtggctgaaaagatgctaatagccataacatgttgaatatgttgtttctttttaaagttaacatgacacagaggaaccaggaaatgcgtctactgcatttagttttatttatgttcttaaattgtttatttccagatttctgtaacatgtatatatatttttaaattcaattttattttgtgtgtgtgtgtgatggagtatcactccctcgcctaggctggagtgcagtgctgcgatctcagcttattacaacctctgcctcccgggttcaagcaattcttctgcctcagcctcctgagtagctaggattacaggcatgcaccaccacgcctggctaatttttttgtatttagtagagacagggtttcaccatgttggccaggctgatctcgaactcctgacctcgtgatccacctgccttggcctcccaaagtgctggggttacaggcatgagccaccgtgcccggcctgtattttcttaaaagatcagccattaccaagttattattggatgcctttaatctcttttgttagtgtatccatattccaataaaaatttatttataaaaacaggcagtggtctgctctataggatcttgcactaataagttactttaattctttaaggttgtcttgagaattaaaacacataatgtacaaataaaacaccatgatttggcatatagtaagcacttgaaaatagtagtggctattttattaaaatagtgtgttatcatacagctcaaaatgctgataagatgaatctgaaattcagacttaaaagtatttttattatagtaacaaggttatatttgggattttaagttttgttctaccaccagtggtagtttaaggcttcttgtataacggttctttgtgatgtttttcttgtcagagacacgtgtgatgaactcttgggacatgttccactacttggggatcctggtatttccttgctcagttttcacaagaaataggtttggcatctctaggagtatcaaatgaagatgttcagaaacgacacaaggtgtcgtttaaagtttaaagtcattttcgactttaaaaaatattctattgatatccattaataatgtagtaaaagcttccaagttactataaagtaatggttctggaaagagcatgttaatttaaaaaaataactactttaggtatgattgacatgtaaagctgtatatattgtatataatacaattagtttggggatacattctaatcatttatgataataacaacttagatctcatacaaaaactcgacactttaactcatctgtcctctcccacattgttatcgatgtcaaaatttacatttttatattgtgcatcaattaacaaattactgtagctatagttatttttaatacttttaactcagagttaaaaatgattttatgtatcaccattacattacagtattctgaatgtaactctatacttccctttaccagggagtttcatactttcacgttttcatgttgctaattagcatcctttagtttccacttgaagtacttcaactttagtttcagttttagcatttcttgtgaggcaggtctagtggtgatgaactccctcagcttttgtttttgtggaaaagtcttcatctttccttttctgaatgacagctttgtgggtaaattattcttagttgggaggcttttcttttctttcagtattttgagtatatcatcccattctcttctggcttgcaaggtttgctgaaaaacctgctgaaagtcttataggagctcccttgtacatgacaagttgctttcctctgctgctttcaaattcttcgtcattaacttttgaaaatttgatcacaatgtgtctcagtgaaaaaattttcatatcagacaggtaatgtgccagtgttttggcaaggtctgagaaaggcacatcttacacaatggtatgaaaacccaatcatcatgcttatgaaccacaaaaagatcaatgaagacatctttatgttcaacctacatggaattctttgggaattgtggatctggatgttcattttcctccccagatttgggcagttttctgctattatttctttaaataagcaatctgcctcctttctctttctctgcttgctctaccacttctataatgcgcatattggtttagagtcctgtaggcttactttattatttttcctctttgttcctttgactggataatatcaaatgatctgtcttcaagttcattgattcttctttctgcttgattcaatctgccactgaagctcacttttgaatttttcagttcagttattgtgttctttagtttcagaatttgatttgtttttttttttgatatggagtctcgctctgtcacccaggctggagtgcagtggcgcgatctcagctcactgcaagctctgcctcccgggttcacaccattctcctgcctcagcctcctgagtagctgggactacaggcacccaccaccattcctggctaattttttttgtaattttagtagagacggcgtttcaccatgttagccaggatggtctcgatctcctaacctcatgatccacacgcctcggcctcccaaagcactgggattacaggcgtgagccaccgcgcccagccagaatttgattgtttagtggtttctttgttgaaattctcatttgttcatgtattgttttcctgatttcgtttagctcactgagattcaaggtgagtgttctgaattctttatcaggtaatttataggtctctgtttctttggggtcaactgctagaactttaatttgttcctttggttgtcatgttttcttggtgtgtgtgtgtgtgtgttcaactgctagaactttaattcctttggttgtcatgttttcctggtgtgtgtgtgtgtgtgtgtgtgtgtgtgttcttttaagccttgtcttctaactttgcatctgaagaaagagtcacttcctccagtctttactgactagcttcagaagggaaagacgttcaccagtcagcctgactagagattctgaaggtctctcagaccttttctatgatatgcccattccattcctcttgttctgtcttgggaggggaagtcttaggattgtgtgctttctttcaatctcacaaagctagactatgtgctgagaacctccttttattttctctagtgcagtgcctcagagtgttcaaggttgtgtgctttcttccaatccagcaggagccagttgctgatatctgtgtgctatctgctggggcctgcatacactatctgcaggggaggttgggctgctggctagtgggtgggtgcatggagtgctgggtgtgcttgtcagttgaggggttctgcaggtgaagtgtcctgtagggctcatgggtgagcctatggtggagtctgcaagccagttaggagactccacatctagctctgaagaatcatgtgttggttgctataagcctctgcttcttttcccttctcctagatattcctagactattcatctgtgaagagtccctcagtattctggatagggaaaaacagaagtgagccttttgggcggcaacacgcaaggctagggaagctgggcactcacttgactcttactttccttcctgggagaactcatgggccaaaagggcctctcttggcactgaactctgctgccttggaggagaaggatgtaggtaaagtgaaactgtttttcttaccctcttcaatgtgtctattcttgagtttttcattctactggggtgctggaacctcttagcaggtctcccaggctcccaaaatggtatttggtatttctgcaggggtttgagggctggaacctactaatccaccaacttgctgatgtcagtcagggtgcctttaatctgaatagtattatttcacacagaatgctatctctgagtttagtagctcagaggcaaaatataaacagttaaatatataaagtaacattattaaatctcacatttattctgtgcacaactacaatatcgcaaagcattatgcaggttccttcttcatgcctagttcatcggtgcttggagtagctagttccataaacttctgaggtaataagaatctgccttgttattttattatttaatgactatatttatagattacagtaaccatggaatttctaaggcaaaaaagatggcttccaaaatagcaaaagaaacttcaaagatctatggaattaagcttttaattatgcacatatgcatatacaattatgtatatcatatatgtgctttgtaaccataatcttttgtctagtcaatgactgcaaaagtggtatgtcagtatacacttacagaattatagaaaagagaagctttcttcagagctcactctattctatcatgtgtttgcttgtttatttatttattatggattgactgacagggtctcactctgttgctcaggctggggtgcagaggcataatcatacctcactgtaaccttaaactcctggcctgaggtgatcctcccaccttggctatatagataattctatatactgttagtttttagtaccacaaagtgttatggaaggtgatttcaaaatagtttcgccatgttattgatttatagatcccagttttgtttctttagttttccatttatttctagtttgctggacttcctcttaaaactgtggggttaaggcaaggcagttccaaatgtagttcctcatacacaaaggggaagtaagaacaccaaacaccaaaatcaaaatgttctaataaaaaaagtttatctctttaaaatgttgaatagacagatttaataataattcttttttaaaaaaaattgattagtttctcatatgataatcattattttaaccccaacctatagtccactgtaagtatccttttaatttgttaaagcatattagttgttccattaatttcatctacttttccaatccatcaatctgtgattccttttacctttctcttattttgggtttcttataccttgatcaaatgtcctactttttcttagtttattcctcatttaggtggaacacatcctctattagctttctgagaagagaatgcgtagattgtgtattttttaaaccttttaggtttgaaaatgagtttattgtagtttcacaatgggttcttggtttggattggtatagaattctaaattataggtagtttttcttcagatattttaagaattgccctttaactaccagagctactgttaagaagtccagtacatttaacttttgtagtatgtgtctcagtctgtttgggttgctgtaaaggaatacctgaggttgggtcatttatttaaataagaggtttatttggctcatggttctgcaggctgtacaagaagcatgatgccagtatctgcttcttgtgaaatcttcagactgcttacactgagggcagaaggcaagaggaacccatgaatacacagttcacatggtgagagagaaaggccagaagtgaggggtatgggtatgcccaggcttctttgtttttctttgttttttttttctttttttgagacagagtctcactctgtggcccatgctggagtgcagtggcacaatcttggctcatagcaacctccgtctcccaggatcaagcgattctcctgcctcagcctcccaagtagctgggattacaggtgtgtgccaccacacccagctaatttttgtatttttagtagagatggggtttcactatgttggccagtctggtctcgaactcctgacgtcaggtgagccacccaccttggcctcccaaagtgccgggattacaggcgtgagccaccgagcccggccccaggctctttttaacaactacctctcacaggagcgaacagagtaagaactaattatcacaaggactataccaaaccattcaggagggaaccacccctatgacccaaacacctcccactaggccctaccaacaacattggggatcaaatttctttttcttttttgagacagtctcactctgtgacccaggctggttgcagtggtacaatctcagctcactgcaacctccatctcccgggttcaagtgattctcatgcctcagccacctgagtagctggggttacaggtatgtgctaccacacctggctaatttttgtatttttagtagagatggggtttcaccatgttggccaggctggtcttgaactcctggtctcaagtgatctgcccagctcagcctcccaaagtgctgggattacagacgtgggtcaccgtgcccagctgggatcaaatttcaatatgagacttggaggggtcaaacaaaccacatctagagaaagagctccagaaatctgcatggggttccttaagcattttatattaataacaatcttacatactcaatagccatgttattagtattgacacattacataattacattgatcatgtagatctagaccaaccactgtgaaaaaaacaaggtgcagctaataataaaaaagatgagttgataatgaggtaaaaaaaatgatgaagatgaaatatcatactaactatgcatgtatatgtgccaggtactgttttaattgctatctatgtcttaattcagtgaatatacacaacacaaccttaagatgtaggtattacctacatttttacaggttatataatttatcctagtagaatcagaattgtagtctaaacagtgtggctccaagagtctacagtcttaactataatgctgtatgtaattccttgcagtaagtagacagtagtagtgttttgttatattgttattaaatgccctttcttgaccaaataaaaaattggcaaacctatcttgacttcccaatttaaaaatttattggctgatgaaatctaaaagcctggaaatcatcaatttatagggccagtaaagaacaaaaaaaattaaaatttgagaagtaactgatggagcaaggtcttaaagggattcagctctagaatacagggagcagttagatttggagaacagaacaaaagctaaatatagaagggattatgaccaagtagagatgatggtgagaaaagcttctctagtaactaaaaatcaaggtcatctgagctcaaaataagcctggtaatgttaatagaagacataattattaatataaaatagtgaagatttgaacaacttttgtcaggaatgagaaaaataaataaatccaggaatgggctgacagagcagaaaaagacagggtttcaaaactaaatcaaagaatgtttagtggcagtaaaaatgtaccagaatgtgagattgtggtcaccagtaaaattgctgaatttaaggtctgaaagccagagtaaagggtcattcattgatggtaaagacgataatgataataaccattcattgagtatattacaaaattaattgtatctagtcataaccactggtatcaccatatcaaagagaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaagatgaataaatttgactacacccaaaccaaatttcagtataaaaacagacatacacggtcaggcacggtggctcacgcctgtaatcccagcactttgggaggcagaggcaggtggatcatgaggtcaggagttcaagaccagcctggcaaatatggtgaaacctcgtctctactaaaaatacaaaaattagccgggagtggtggcgggcgcctgtagtcccagctacatggaaggctgaggcaggagaatcacttgaacctgggaggcagaggttatagtgagctgagatcgcgccattgcactccagcctgggcaacagagactctgtctcaaccaaaaaaaaaaaaaaaaaaaagacatacactaggagaagataagcaacaggaaaagataagcaaccaatgtaaccaacaaggtaatattttccagaaaacatgtaccagtgaaactgatgaacaaaccaatagcacagtgggcaaagatgtcaagagcagactagtaggcatttggaattagactcctagaattaagattagcctaaagaaatctgggctggaaatagagatttgggctatatcttaacgatcatatttgaatttggggcactggatgacctaatgggaaaaaaacatgaaagaaataaaagtcttgggcctagctaggacaggcagaagatgagtgatccaagctcaagtgcttgaaagtaaataatgactcctttaactgtatttacatatttatcttgagttttctgaccacagtttctttatgtcttttaaagatggagtctaaaaacactatcgcataaggtggtcagataagcctattacatctatttagagcaatattatctttagaccatgtttcatgtgcagccaagaaggcagggttgtggaaatgaaatacaaatataaatgaaaacaggatttaaattttaagtaaagggaatttaagaaaatattccttttaagtggataataaggatttttaaattggtggagttaggaattatctcctattacacattcgcatagctcatgtaatgcatcagaatacctaatatatgatccacaccttttctctgaatttcaaggcctcccaaaaaagttttatccatatagacttgcattcactacattttttctacttgaaaatagcaaaccagctattcacataaactgctaagaggaagtaagccaaccataaaaaattacatactgtaaaattacttatatgtgagggtcaaaaacatgcacagcaatacagaatagtagtaatggtggtggatgtggttggaagggtcgctttttaaaaacgcctctattgaacattctgtatattgatgtgggtggtggttacctggaactgtacatttggcatttgagcattttactatatctttaaattgaggtatgtattttttaattctttaaagaaaaactgcttggaggtcttattcttaatgcacaacaatcacaaacattaaatttatacagtccagagaatgtaaagttgctttaaaaaaattctttccttttctcactttaaaataccaaggggaaaaattaaactcaacacagcacgtcttgcccttgtcaagatgacagatcctctaagagaagaaacgaataggtaatggccttttccagattttcttttcctaatgtaccccacttccaacctacccctacctcaactagggtatctagttgtacccaagggtgcttctacattagatccacagagattaaagataacagttaacagaatagtccagaggacaaggatattcaagttccatcatcttcaggataaaaaagctccagggtttacctccaaactctctctaaaggaaatcccatcaaccttttaaacatcactttgtatacaccatcttctgtactgccctagctcaaaaacatgaacctgtatctaaacgtgtttgtagaatttccattgtaagttttactttaacaattttgaacaattataatgatagaaaattatttaatctagattttggtcaactctattactgatattcttttttagtgaaggacaatcacaaacactaaatttatacagtccagagaatgaaagattgctttaaaaaattccttccttttctcactgtaaaataaaaataccaaggggaaaaatggaaagtatttattataactggctgttacactgtcatacacaatgaaatactggaccattagcagttcgttattatatgttgttaagtgtagaactgtaaataatgaggcatattattaagatatcacacacattatccaatcagcaagtgcacaacttcggacattttgacttcagccaaaatatgaaacaaagtcatagcaagaaagttatttcaagggagtgaaattttctcctcttacccttcaaatcttttagagatattaataaaaacaactatccagcctgggcgatataatgggactccatctacatacacacaaaaatttttaaaattcgttgggtgtggcagcacacgcctgtaaacccagctacttggaaggctgaggcagaaggatcccttaagccggagttagagtctgcggtgagctatgatctgaccactgcactacagcctgggcgatagagcgaaaccttgtaacaacaacaacaacaacaaaattaaaaccttcaagatcaagcttgcccaacaggatggctttgaatgccactcaatgcaaatctgtaaactttcttaaaactttatgaaaaaaaatttttttttagctcattagctaccattagtgttagtgtatttatgtgtggcccaagacaattcttcttccagtgtggcctagggaagccataaggaccccctgcgctagacttcagcagaagccttgtaacataaagaaaaccatacataaggctttagattctttttttttttttttttttttgtgacggagtcttgctctgtctcccaggctagagtgcagtggcacattctcggctcactgcaacctccgcctccctggttcaagcgattctcctgcctcagtctcccgagtagctgggacaggcacctgccaccgcgcccggctaatttttctatttttagtagagacggggtttcaccatcttgacctggctggcctcgaactcctgacctcgtgatccacccgcctcggcctccctaagtgctgggattacagacgtgagccaccgcgcccggccagctttggattcttttaccactttcccgaaggaaaaggaactgaaaatatctaaggaaggactactacgaatcttctctgagtggcaaaaaccagaggtttttggagctagggctgcagttaagttgccaaggggcagagatgtaaacagttcctggtttagttaaaatattttaatttttatttttttaagcctggcctttgggtgaaggagtaaaattaggcactggggtctgggtagggggaggatactcatgggcgagtatgcaaccctagggccacagcaaccaaactgtaggggaagaggcggggcgagaggggacgaagtagagacagcaagagactcacttttgaaaggcactttcggttagaaagcattctcacatgcttatctcatcgcacacagtatcctttctgctggtctccagcatctacagacgttaaaggcccaagaggagggccaccttcacacgagattccgaggagggcctcgctacccgccagttccc

SEQ ID NO: 461 - DNA, 32028 bp, Homo sapiens; identical to SEQ ID NO: 455

SEQ ID NO: 462 - DNA, 32028 bp, Homo sapiens; identical to SEQ ID NO: 455

SEQ ID NO: 463 - DNA, 32230 bp, Homo sapiens
atccaatagcattgacttttattcattcatgttaagtcacctgaaatgatatctgttgcatttaaatgctcattaatgtaaatggctgaacaaatccatttcaatggatactcaatatcccacatagataagtcacttcaacacagcctcatgacaactcccacaccaaaacagtactttattttgcaaattttgacccattattactcccatgttgttttttttcagctgtcaagtgtacaaggtgaagagaaatttcagttagacaggggctgcacctggaaaataaatttcttaaactccataaacacatttcaaaactgctgggtcccaaaagtccatctatgaactctagggctgccagtatcatgtgcagcacattaaagctacactatccaaatagcttattaattctgcataaatcaggtcaagcaatgtgtcaacctgtaacagactgtgcactttaactgaacatggcaaaatattcactctttcgaactttacatcatcatttgatgtcaaacaatgaagcaaatcccaacagtatatacaaaaaacagctttgcatttacaaaagattgtttcccatactgattaatccaggcagctaactcattggtttatgcaactttattgaagaaaaataaatcaattactagcagagctattagttgatcactcatccattgacaacttgcatcatttattcagtgctatattaaacagtgtattggaagatagattaactaatagctccaagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccaattctccagccacatcagttatgagcataaagcatatcatgtaacctcaaatctctaacagtggaaggcttaaacaagaatggatgctgctagaataatgctgtatcctttgatgtgacaactgagcatccatctccctccccctcagatgatttcttcagcatgttagagcagtgaggaatggttttagtctcataaccaagttagagtgaagacattggccacataatacacatgctccatttttttttttaaaaattctgagtcttgggcaactgttctcttgtaactactttacagtttctaaaagcagttattgtccaaagctggaagaacttaagtcttctcagatgagcatgtgaatgaatggagggaggtaaacaaaaaataaaattaaaaaagatgaggtctgataggggagcagccggataagaaaatcaaaaaaggaacagtaatttaaagtttattccagctataatgcaggttattctgactttaaggtagcatcacatggcatacttctgagtccattcccgagatattctgttgtacctgtaaataaagatgttatttttaaaagttaaaataaagaattcctaatactttaaatggaagggaaagatttccattttatcatctccagactcatcatgaagtcatctctaatgactatgattagaataaaagccaacaagggagaaatagcactggtactcaaagcaatgtgggaaatgagagcctgatgctctgaaagtagtattttaaaaacaactaagaaagcagcactgaaaattgggaggctaacaaaaatcaaaagaccctttctttctctaccaccgagctcatgctctaattttaacgtgaagaaatttttacagttcattatggacaaatgttaaaatagtatacacattctatctatccacagaaatttccaccaaggccagaactaggcttttactagaacaattttatctgaatcctagagtttgggaaattacttggtcctggatattacaagaaaaaatggctttgggacttaggtagaggcagaaggggaagatgacactgggcagaatgacaaagggcagtaattttcaaaaggggtgtgtgtgtgagtggttgtgttcatcagaatcacgtgttacttttaataagtgtggtaactgaggctaataagcaccactgagacctgttgagtacaacaagggcatcttcgtttaaaaagatcaacaggtaattcacacacaagcaaggttattactcaggaagactactaacattgataaatactatcagcttccccctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcctaaggatactctctcaaaaagccagcactttaaaacaaaggctttatttagcatacagggagccacaaagtacagctgacgctaatgcatgcttgtcagtaatgaacatttagtttagatgcttaggcttaaaagtgtttttcccttacattactatctcctggcaaaatttgaactaaaccaccacattctgtataggattggtacaaagtctcaagctaaaatttaaacaccatgatagtttgaaaaaaaaaaaagatactacataaattcccatttcttactagtgctattgtaactgctttgccatgcaatactttcaagcagtaacggctaccagatatttactttcacgttaaacagagaccaagcagttaaatgtacagttttcagaagactgccatatttgttaccttttgttagttaatacagtgccttaacgcatgcagcactcaagtgctggcagtaccataataagcgcaccatagagtgcagatcctcttaccctacaacatagcgtatttctctgtccactctcttgctaacctattgtacctaattgaacaagtacacttagcattaattataacatatgaaagttataatggttaagttgaacataaatataattcaaatatttgagaaatttagaccaaatttttacaatagtactaacatttttggaaaaacatgcttggggtaaagaaaaatttgctttcttccccaaaagttgagaataaagtgatactgtttaacacgctaggaaaaaaaaaacaacaataaaacattttagaggggagcattcactgtcacataagctaaagcctagttaagtttttttaaataaccacatttcaatagctttctccatattttaactattatcttactaaatatcaagtcttcttggcactgtcacaagcaaagtataagcctaactcattaagtaaaaccacttttataataactttttaacatacttacttatctctgtctgttttatagatccgtgcaatctctggcactagggggtcatctgggtttggatcacatagcagtgaacaaatggataaaagaactgcaagaaaacaaaaacatctgttacccagtttcaggagtttggataaataaatttttctaaaccgtgtattacaaaactcaatcctcaaaagacttttattagtttgtatctttatctcaatgagacacagttttacagagattttgtttcacagaagacaagctcctggtaagtaagaagtgctaaaaacagggttttgtggcatgaaattcactgcagactagccataaaaatagtttctaagataggcaactgatgccatattaatatatatattttaaataggcataaatgatattagaacttgagtttcttggtactctgtggctgggggggggggactttagcaagaatatgcaggtaacactcatgccatattcatagccattaggcatgacgaaaaatccattcttagccgctgtcttggcaatttctgagaaaaaccctcaagtgctccactaaatgtctccttgaacttgtaagcaagaaaccatattcccaagagtactagttaaatacaatgccaaaatctctttagtactaagtgagtcatcagctctagttcttaccttaaccagctcaacatactgatgcataagatgtcaagcattaaagaacatagatcgcattcacctttgagtgccggtatgtgccagcaacatatatgtggggtgctgtattaaaatgttaagatataaatgctctgaaaggttctgaccggttttttttaaaaaaagcaatagtataaaaaagcacccttgtcacatatttattgactacagcaaatttaatttccaaaccccaaatacagcagaatataaaattacctaatataggagacttggctatacaataactcacagaaaaaaggtagcttcagttgtgactgctagtttaataagttagcaaagtatggctgccaaaaaagtaagttgctttaacgacaaaacaataccaattcaatctgcccttacaaaaacagttttcagtgttactgtacactcccagcagtagtagaaaaacttggaaactgatatttaggtatgtagcatgatttgaaaagaaattagaaagcatccaagaaggtgaaaaacaggtgtaaaattttaaaaacactcgaattatggcagcatctgcctaagttgtttctttttctcccttaagtgattctactcaataaagtttgggaaatgctactgctacagtctctctccatgagattcaagtgcagtatatacacatatgaaacttttatacaatgccttgccttttgaaaaagcttttttgtacttactgaactcataaaatcaaaaaacaattaatggtgaaatagtgttaattattacaacttcacctgggatattcatgcggagaccggaaaacttgttacatataacgtaacagatgcctattaagagaccagaattgatctacagatctttcgaagattatataattttagactgtcattaggtagaaacaacctatcatggttacataaaacatgactgaagatttgtctaaaaattaacccaggaaagcaaaatcagaattttcctagagtggaaacctcagaattcaaaagctctattaagtttaggtatatcataccattcttggtaaaaaggccgcaagttagtgtgagatgtccaagtggtttgggattgaaaaatacagaagtctattaaaataaattttgctattataagatgagatgaaggtaactcattaggcaaataatgcctactcaccacaatttgaattttaacaacttctcacaaagtatctttaatcaacaccactaaaagaacaaaaattataaaaataactttattgcttccccatctcttaccaaaaagctgccataataaaaatactcagataagtagatctaagaatgaagctttattagacaatgagaacagcttatttcactagaaatatttacctttagaaattgttaaagcaggcgaccactgtgatcttagaatatcgagacaaatgctgccattactgttaatatttggatgataaattcttgttgtaaatgcaacctaaaacaaaaacttttaagtattttattcaaataaaaacaaacatcttttaaagcaaaacttaaaataatcaagccacaatgttaaaaatgtcatctattagcatagaagttctaaatattatagaaactgatttttacaatctgaccacaaccccctgcctcctctttttacaacagaaacctaaacttttggataaaaatttcattactcatatgatgtaaagttctaaaggttactgtggccctaccatatcatgaatcaaagggcaatttaaaggtatttaacacattcatttataaaagccctaacttttggatgtaaccaaaatttgtagaccatctcatttaaagtttcattaagttacacaggtacacctgagtctgcatttccaccgtacataaaacataaacttgaatcacaaaaatggaaaccatcacattgcacctataacattactagagattgttatagtgacatgtttatgacctttgtatattaccttttctagttattcatacaggttgaatttatgttaatgactgaaaagtgaaggataatatgcttttaatacctataaaccagtgcactaagcaactctaagttttcacaaatttacacttacgtatacaaaactataagcataataagcatatgctgtaacaatacgtgcaaatataaattgaagttggacatttgatgcttacaagacaacaaaagcccaaaaatcagaatctgtgtaacaataatacagatgagggcggaagcttccacatggtctgaatcttgcaacattaaagaaaaggcaaaccttattcctatttacaaagctcaaactgaggtctagctctttaaaccaaaggttaagagtcagcatctatacatgagtgcaattcaacatatatatacagcctacacagaaccctatcttccaagaatgctctattcctttgaaataaagcataaatctatactaacagattttgagggaaaatacttgccttaggtggtttgaaggggtagtctgtaggaaaatgaattgtcaaaaagaatacaccgccttgatatgggctgtcattctgtaaaaagaaaagtatgcttaactcaaatttaaaatattattgctaaatattccgtaacatttgtttccaagcatttctctaataatgaacccaaatcacctatttacactgcaataaataatctattccatgaaaattcagtctatagtaatagaaaaaaacttaaaacttatacagtaataaaccctaatttacctagtcattttacacgtcaccaaaatgtttttttaaaaagttatccagaaacgcaagtattctagatctcaattctcaaaagtacaacacagcaataaagcctacataatcatgtttcagaataatctgtaaacaaaattttacacatgtagattatttcttccaatagccagatgtgtacaaatggcttcacaacagtccattctgcccactggcaaaccaaatgttagctattccaggtaacacacacacaccaccttcaagaggagaacagagaaaagcctaagcttctcattttaatcaataccagaaaatacatgcattgcccctattttatgcatgagaaaaatgaggcttaaagaacttagtctagtgtacaaatggtaaatgatagaaccaagattcaaacacaagtcttttgaagaccacttaatgatcaaagatactgacctactcaggaatttaaagttaaaatgtggaatgcctaactgcttctgggtatgcaaagaaccaatccgaagacatgttttacaacttacatgaactgggtttttaccaacactgactcccctctattagaaaggctttgtatatacagctatatatgagcctttcactatgcccattctggatgtcaggcacataaaaaacaggcctgacactaacacagctcatctaattcctacccttctgtaaaataaataaacattaattcaattaatctaaccccttgctatatactgtatgtgtgttaagggatccaaagaacaattttttttatcttgatgagcttacactgatagacatgtaaagtaactgcaatgaaatgttataggtatcatgaaatatgaacaagggacacgagttcaaagaagaaaggtcaatttattaatgaagaatcaggttcaaagaaatatacaactagtaaatggaagagcttttatttatttgagacggagtctcactctgtcgctcaggcttaagcgcagtggcacgatctcagctcactgcgacctctgcctcctgggttcaagcaactctcctgcctcagcctcccaagtagctgggattacacatatgcaccaccacacccagctaatttttgtatttttagtagagactgagtttcaccatgttggccaggctagtcttgcggcctcctgaccttgtgatccacccatctcggcctcccaaaatgtgctgattataggtgtgagctactgtacccagccagagcttatttaaagtgagtccttctccatctcccaagtcttccccctttttttttgtaggggtggagggcggggggaatgggaacgggaagggggacaaacaagacgtagaatatcatcttgctgtttgttgcccaagctcgagtaaaatggtgcaacctcagctcactgcaagcgccgcctccccaggttcaagagattctcctgcttcagctgcctcagtagcttggattacaggtgtgcaccaacgtgcccagctaattttttatttttagtagagatggggcttcaccatgttggctgaactcttaactcctgaccccaggtgatccgcctgcctcagcctcccaaagtgctgggattacaggtatcagccaccgtgcccagtcctttttcatattttctacaaaatatggaactagaaaaacactcaggtcacttagaatgtgacctgagtttattagattaacatgtctttattaaatagttatattaattttgaatagatgcttcaaatagcatatactttcacctgatccaatactatacaagatatgttttttctgtgtaaaattaacaatttaaaggtaatcccaaacactaaagttgtttttgttttttttgagacagggtcttgctctgtcgcccagactggagtgcagtggcacaatcttggctcactgcaaccctctgcctcctgggatcaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttcatttcaattttcataaaatcaaatgctgtctatgactgcttctgaataaaggcaatctgctgatgggatttaggcaaagccaaatttcgtttcgtttgttcgaaaaaagaactttataaagaaggcaaaatatttcaatgttacaatttaacactaaagttctgccatgccaaaagaggaagaactacgaggttcagagataatgaaactaggcaatataaaaaattgagaccctatgatatttaaattctattatgaatcagcagcaaactacaccaaaaagaaacaaaatccccaaagaataaggaacactgtgatcagcaaatcgactcaaatcgtacaagtccagaatttatgttagattttttcagaaaccttctacttcttttgctctcatcagtgcaaagttgctccctcacagtgcctcagctcttctgtggcaataaaacgttggtattcttttttttttttttttaaagtggtgctgtcgcccaggctggagtgcagtggtgtgatctcggctcactgcaacctccacctcccaggttcaagtaaattctcgggcctcagcctccaaagcagctggaattacaggcatgtgccactacacccagctaaaaatgctggtattcttataggttgattttctactcttaactgctgacccataaaaatttgagttgcaaaatatatctctggtcagttattcattccagggcatatattcaaatgcctactgatatttctacttggatatctctacttggatatctcatgtcatgcgtccaaaactgaaacttgtctcaatcccttttttcctgttttttaatagcaagccataactgaaagccataaaccaggatctcatcatcaacttcttcctctcttatctcagaatcaagatagttatcaagtaagatctttaaaatttcttgaattagcttctcctttatgcccactgtcactaccatcttagttcatgatgttatcttcagcctagattatggcaatagcttactaatgattatccctccatcctaatgataaagtggtcttttaaaaatgttactcccctgcttgaaatctatgatagtttttaagataattccaactcctaagtacatacggtgctttatgatctgggtgcccatctagtttcatcttctgtctcttctatagaacatgttctctactgcacataaaatattatatggataacatatctttttctcttccctacttggaatattcttccttataatatagcccttcctttgtcttatctgctccctacccttcttttatacctctttaagcacatagttaccattatccacccatatatctaacatttacttatatttctcttttattagactacaaagctcctcaacgagtaaggttaaaggtggaaaaagtcttcaggtatcagtaacctacgtgggaaatgacataataatacacttgaaaaaaaagttgaaaaaataatccttatggaccaaataaaatagtacctatggaccaattattttaattcagatagtttttctggttgactatgctcaggctgccaaaggttacatttttcagatactttcacatttttcacaggtactctcttctacatctctgtcatagattaggtgggagttagtgttgttctctaaatccactttttctggatttccaataaaaaaaaatttaagcaagtaaatatcagaggcaataggtaaggaagtcaatttcttctaattacatcaattcttgttggaaactaaccttaatacagtaccccacgcccccctccccaaaaaaaaccacgcacacaaaaaactagcaatgctgtcatttctttcgaaggtttagtttttagtcaatagttgtgcttccgaagtagcttaccttcagaaagaataagccagtacatatgattattaaagccaagcaattttgctgcataactaatgatctaaaggatttcccaacaactcactaaaatcaaagttactctattgaaactcaaaattagatggtatattccctacagtcaggaatcttcagttctgtggcactggcaccactttaagggacctaagtagtagtccaaagcaaaagtgacgttgttaactgtccagttctcccactaaatctgtaatttatgggttgctttaggtcacaactgcttgctacatagagcaaccatactcacaaaataagctactatttatcttatacagtgatgctttgtcacaaagaagtattgagaagccaaaagaacaaaatgagttgtttcattggtgcactccacagtaagcatatagttaactatttaaagctggcatctaaattatgtgcttacttatgtacaagacaatacccgtactttgggtggatttttataatctttgactccttcttgaaatttacccaaccaacagtgagaactaacctttttaactgaaaacatatttcagtgagtactgctaccaaagcaaaacccagcagttgtggttaatcaggttaatatttaaatggttctgaaaatcacatgcttctgtttgtaaaagcagaaaactgctagtcattatattaaaaggttgctgaaaaagttcagcaaggaatagccatcacctgaaatatatatttaaaaaatgaaaaaaggtaaatgttttctcaaaataacagcaaattaagtaaactgctaaaaaatctgtcagaataagcaacaccattctctaaaaaaattactaccatacactcatcattcatgtttccttttgattgtctataggtatgttccttgccttttgggaaaaactagtgtgttgttcaaaataacaaagtctaaactgtcaagcagaaaaaccaactagttttaaagagttagtttattctgcacaccatccaattagaagttttaattaccaacgcttctgtgctttcttagtattgacaatttttataatgaaactatcaactaccctctgaatcaaagatgagctttattttaaggcattttatagcattctttgaaaactggtaatccaaaatgggaaaattctagaggttgcaaaagcaactgctttacaaaacactaggcagataatatggaattgacctagtaggcactgtggtaaacacatatcccatctaaaaaagggaggcagctgtcattccatcccaagccattactgcttatggaatgtgggcctactcagaaggcttttatttgaagactgccaactttcaaaaatatcgtgtgggccaaactgggtaactcaacatttaactgcgtgtattaaaattaaacaatattgctaccaaattagataaaagtaagtacttttaataactacaaagccaggattgtgcatttcgttattacaggactatttttactgttttaaatgttactttgttttaaaatgatccaggacgtttcaaagtattaaacttaatatttgcacccctgccatgtcttactttgatttagtttttctacctttagggcactaacattttaattactctaaattaatcctccctgctacaatttcccattaatttatcctactcagcacttcattcaccaatcacttattttccatcttgtcacacttcagcacttgttttaggtatctgtctcctctaatacagtgtaagttccctataagatcgacagggatgtttattatgttcaatttgtatccttattacctggcacacagtatgtactcacatttgagacagaaaaatgactaaagttagaatcagaattactaaataaatacttgttgattcgactcatctactaactctaagagcattttttcctttagaattctaaatattacttactgaccattatctcacctagtacattattgctctttatgttgcttataaaaccaccaaaaagggaagacagttttcaggaagatacacatgtaacttagaaaacaaatccttaagcgccttagcaagttaaaaaaaaaaaaaaaagttaaatatttgtgtaagatacagtcttaccccaggatgttttagtgcgctctaattctctgaaattcttagatggtatccataattctgaatattcaattatccagcatatagttgcttatctacccaggatagaaaggaattttgctatattcaaaatatcactttctgcctaaatatattcaaattttgcataaactgaagttctataaagaatcaaatatcaaaatacaattaagctagattattggcagctgcagtaacagaataagatctctgagtaacacaacgcatggcagatcagagccagtaactttgtctctataaataacaggaagttccatgacaatgctttacacagtgctatgtagaaaaactgaactgagatacagagatgtttggtaggtcatagagatggctatactctagaacgtgaacacagggatagacacaaagtacacgtaacaaatgactaactcattatgttttttctttcaaatgcagtacaactatggaatatccaaaatagaattaactatatgataaaataaacctacagaccaagttaaaaattacaaccaaatcaatgctggattttcacttaaaactaaatttaaaaattcttaatacttacaggtcccataattgtggcttgccaatgaaacactagaaaaagaaaaaaaactctggttatctaaaaatgcacaagcttaaaaaaaaattaggcataaaaatcaacttgcaagttacttactatcatccccaactggacctgcagaacattgtgctggagggtcacgggccaaatcactaagttcctacaccaagacagaaaatgggtgagtcacataagcttaatttaagaaaacaagcgagtccactgctttcagttactttcaccctatttttaaaggcacactccatcacaattcacataaataatatattccattaggagagagaacatgcctgaacatatgctgagacaatcatcttagctagagttcgtaaaaatatatatgcaaacacattgatacaaaattttttatttacataaaagccaatctcttacaaaccgaaatagctataattagatattctcatagtttaagagcttagaccagagagagctcaacattcacgttatttgttgaacttccaagaccactttcagaggccctcaactgtcttaaattctttgttcttcctgaaccatccttcctccccaatccactaactctattttctacctgaaaacaaaccaaaaaaactctcatggggctaagtaccttttttgttttctaatctccttattctctcaactcaaccttttttttttttttttttaaactcagcatccatttttaactattgaaatttttttttttttgagacggagtctccaggctgcagtgcagtggcgcaatctggggtcactgcaagctccacctcccaggttcacgccattctcctgcctcaggtgcccgccaccatgccaggctaattttttgtattttttagtagagacaggatttcactgcgttaaccaggatgggtctcgatctcctgacctcgtgattgaaattctgaccctgaagagcgtacttctgtaagtagaaagacgtttgctcttaacatatagtctgcacaattcaatatgaacgttttatttccaacaagtatgtagttcactgttccatgacttgtgcataacaatatgaattatctactatgaaaatatagtttattagaatatttttaagatggtacagctccatcttaccaatgatataaccaatgtctaataatcacaagttaaaaaaaaaagacaataaatagaaccaatgttaatacattactgccttcaacattttcaaactaacagtttctcttaagtttagtctatggcataagtcagtacacccattaagtctagggactactatatcttctatatcccctttctcatataaacatggaaataacacagaagggtaaggtttgggattccatttgaacagcagaagaccactaggtacgtggctcatgcctgtaatcctaacaccctgggaggcaaagacagggatcgcttgagcccaggagtttgactgagaccagcctgaacaacaaagggagacccccgtctcttcgaaaatgttagctaggcatggtggtgcatgcctggggtcctagctactcagaagactgaggtgggaggatcacttgagcccaacaagtcaaggctgcagtgagctgtgatcatgccactgcactccagtctgggcaacagagctgtctgagacagaaaaaaaacacaaaatcctgtctcagaaacaaaaaaacaagaccaaaaaagctagactgggcacattggctcacgcccgtaatcccagcactttgggaggctgagaagggtggatcacctaaggtcaggagttcaagaccagtgctgctaacatggtaaaaccccatctctactaacatcacaaaaattagccacacatagtggcacacgcctgtaatcccagctactcgggaggatgatacaggagaatcacttgaacctgggagggagaggctgcagatcgcgccactgcactccagcctggggaaaagagtgagactgtctcaaaaacaacaaaaaaaaacccccagaaaagctgaacgtattcatatacaaaagaccaagtactagaaagcaaaagaaaggatgcctaaataaaaaagatacaacagagaagcagaggcgagaggacagcttgagcgcaggagttcgagaccagcttggataacatagtgagaccccattctccataaaaagaaaaaaaaattacgataaagccagtatcaactgtctaccacaatatcaatgcatccgtgtataactaaaaacattaatcttcttttggtctactagaacaacttattccctataactacaggaatttaaaaatggaaacagattttcaaagtgggtacatgcactttttttcctcaactgtgatcttttgccttcctgtgcaaaatcaaggacacaaaatgcagaactttcagtataagctctctcagaagggtgcagggaatgggaagaagagctacaaatcttaatttaacaaggcatagtggcatgtgcctgtagtcccagctactcggaaggctgaggcaggattaagcccaggtgtttcaggtttttgtgtgttaaatgatcatgctggtggagagccactgcactctagcttggacaacaatgtttaatgcctattttatactggcttcagatgattattttcattcactacatcaaatttaaacacagtgacaaatttatgtaagggtcccactatggcactgacttggttgggggaaataaatgagtcctctaaattttgttcattttgttaaatccaccggaaatctttaaaataggctctcaacaaactgaggggccagaacaaaaaacaacccagcttccaagtcttttagaaaattagaatcattgaatagatagcttgaaaaatcagataatgttgacatctttccctgcaaaactgaggaactgaacaaatcaaacaatgtatgcaccaacagtacacaagcctgtaactgtgctttaaatatttcaatttgtgggaaagctctttcaatggagctgctatttttattgggtaagtttgtattctgtagcagcatggaataaaattgaaatttcgagaaacactgaaaaagaaaagagactacataaagtgtttttgtcttattaaaaaagaattgagactttgtcccatttaacaggatttgctctaagcttttaagacaccttagctcccagagggcattttgccatttaaaaaattatagtattatagactacagtcaatgggggttattaatttaaaccttattaacctcaaaagtgctactttcaacaagattaagtaagactattagagatattagcaaaacagcactgagaaacagggctaggaaactagagtacacaaatcggactaagaataattgtactacctttaaaaatgttaagatgatcaacacaaagttttaactgctctaatagtatcttttttaaaaaatgaagttttgattaaagttgtttagttaaaagtccaccaatcctctccccttttaaaaaagtgatgggaatctcactatgttgcccaagccggactacagtggctattcacaggcggaatcacaatcataaggcactatagcccagaactcctgggctcaagggatcctcttgcgtcagcctcttaagcagctggagttgcaggtacgcatcactatgtacagcaatttgttgaacaataaatgtacatttttaattgtaaaattaaacaatgaattttgttgattgactccatgtgggaagaaaaggtgacgctaagatttttggcctgagcaaagcatgagattggcattaagtaaaatggtcaacttacaggtgaagcttgtgggcagatgtagagataaagtaagtaaaataggataatgtaagtaaagactcaattcgaaaagtatatatacaagttgagaacaggctgggaacaaatacaaagtatcattaataaacaaatgatgtttatagccattcaacttggtgagagcactcctggaacagaaggtcctaggagttaacactggactaatttaacgctaagaaagggaaccttggccagtaacctgaaaagttaaaaagaaataaagaatgtgaagaaaggctttgtcacaataaacaacactgcaggaaaattaagaggcaaatatttgcctcttatattcaaaatacacttcagaaaatggccagttgttcgggaatggtcagtctagattaatgccataaaacaaacaacaaaaatagagtagacaaggagaattgtcctgatatgctgtgccaattcactttggaaactcatcacaactacttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtggtgtgatcttggttcactgcaacctcctcctcccaggttcaagtgactctcctgcctcagcctcctgagtagctggaattacaggcacatgccaccacacctggctattcttttttttttttttttttgtagttttactagagatggggtttcaccatggccaggctgatctcgaaatcctgacctcaagtgatccgcctgcctcggcctcccaaagtgctaggaatacaggtgtgaaccactgcaccaggcctgcagtcttacttttaatcttacacaggcctactttttctcatggttctcttctcatctctgaaataggaatcactacctggcacataatggactggtacttaacaagcagaccatgtgtagaccacccatcctgaaccaagattcctgggcaaggctcttaattcatctgttactgaacaaaagcaaaactgctccacacatgggccacataatatagccacttgtttatttaaatttttgacctatgtgataaatcctgatgctcagttgtctaaaaatgtctttgtaagcatctgaatatacctaatactgaaataagagtttaaaaagctgacaacacaatccaagttttacatttatttactcataattaactcaataaacatactagattttacatttaatatatgttaaaatggctgaacaaaaatatttagcgtaattttcttttttttggagatggagtttcactcttgtcgcccatggtggagtacaatggcacaatcttggctcactgcaacctctgcctcctgggttcaagtgattctcctgcctcagccttccgagtaactggaactagagaagtgcgccaccacacccggctaattttttgtatttttagtagagacggggtttcaccatgttggccacactggtctcgaactcctgacctcaggtgatcaccttggcctcccaaagtgctgggattacaggcgtgagccaccgtgcctggccagaataaatattaagataaaatattttaattttaaaataaaaatcaatgtaatcatggttgttctaaacacaatacccaataatgttggaatacttcattataaataaaactaaaggtcagaaaactatgaagttgacctagaatataaacaccatactacttcaacattacacatttcaattacaaagaaagtaagaaagtatttcttatagaataaatgagttttcggcacactgatatttatccatcactaagcctttaaatgctagcattatcatccttttagagtgaaggtataatttcagctagttaacactgggtttcagctcttcactcctgtaatttcaggttcttgttactctcctaacatttctaaatgccttactttcgaagttctccatcaccaagacatctctttagtaataatcaaagagataaaatcagcccaatacacttacctactttaaattcaatatagaaaaatgacctaagtattttaacaatcaaaacaaaggtcttttttaaagatacaaatgctgttcttatttcaccattttctttcttgccatttaaatagtatctaatattactatttaaagtaccacttagtacccaatagtaacaaaaccatgcacaagcacttacctttgagctaccaaataatttttgtaacattatatgcccacagaatgagcaagacagtatcgtaggaaaaaaaagtgagaaaagagtaagtcatagcagatgctctttgtagctagcagacattttgtctactcaataaaccatcttactcatgaattccttttcccttactccaaatcatgtgactgtagtcctgggtcagccatcattaaccaattatttggacatgactaaccacagaattttgttccctcagctgggacccaactattagtccattgtccatcccaacctaagagtttccaaatcaaagggacattcttccttctataatcaagagctataagaatgtgacccatagctgttgacaggcacgtgtcatggacttacatggtaaagtcaaaagctaaagagaccatattcaacagcagcaataacaaagagctgactttccatacagatgtgcaattttggttcctgaggttgtagcttgctctggttcctacacctattccattcattgttaactatcccagtttccttctaataaatcccttatttaatctggattatattaaggagttaaaaaatatatacagcagtagtgagagaccaaatctgaataccaattatgtagattttatgccacttcaaacacaatttagtttttgagttttgctgaaaaacatgtaagaaatctaaatgaagctaagtcttaaaattgaattaggagtaacaaggttaactttcacactggaggttaatttaaatccatttctaaaatgaaaatgtaatgttaatttcaccatcaaaacattcattcattcataggaacattgcctttttggtgccatgcatgttaggtataaaaacaccaagataattaagatagaaatgcctcctcagactcagctaacagaaagcaggtgcaagacaaaacaaaaattatactttaacaacctacacgcttaaaataaagggactcaaatgctctgagaatcctgaaaaaccaaccactaacttttcctgggtttagaggagtgccatttgagctggctcttgatggaaaaataagcaggcatttaccaacaacaaggagtaagagaagcattctaggtagagaaactcaaagtcaggagtgtcaaagaacacagggcataaaaatttgccagaacaaatactgcagagtttggtataccagacagagtacactaggagagtggcagatttagctaaaaaggcaggttatgacttgatcttttaaaagagcccttgaatttagtcagactattccaaaggcaatgggaaatcactgatggtttcgaaatagaagacaaatgagttttgatttttaaatatactagcagtcgtacaccacaagtgtttaactgtactcttataaccactttacggaaatagagctcatcttctctgttttacagttgagtcccttaagagaggggaaagaaatgattacattcaagcatagaacatgttcagctttaggataggtgaactaagtgtacctactaacaacttaaaaatttggactaggggtaagtttcaaaaaggttcctttctcaacagggtgtccttgcaaagataatttaatgtttggcaaactgagggaaaaaaattctcaactgcaccaaactattactcaatgctccagaatgaacacgatatggaaaactaatgttttccttagtatttatttccgcataaccatccaccgttagtctgtatctcattattcgtacgtagtgtgaatccagtactatttttcaagttacatggcctgagaaaatgattctatcccacagcaagaccatttactggactggaaatcaatttccaacgacacccatactcagcatttttaaaagtaattttgtctacgatagtcacctaacaaaatgtttttagagcctaaagtttcacaggcttcagggacaaaaacactaaaaaattacacaattgaaattttcagcttattccttcctagcagtctagaggaagaggaacagtgccaagaaccagaaggaacagctctcacacggcacctgtaaaatttttttatactgtgctgactacccctcacctaaggggaacagcattactcaactattaaggccactgaaacaggaaaatgtttggttggggacactgacttactttaggaattgctcaaggttccactcacgttgaagggacactaagatcaagcacatacaatcagggtacaacactaagaaactgtactagctataaaaagaacaaaaggttggacatttcttttccacagagtgctcttttaggaaactttctccttttagtgtcatcttcctctgagctgcttctcctcaaactttctgcacacttggctagtgtgagaatccagaccttctcactggaaaaaatacttgtatttaaaagccttaaaaaacctataggaaaagaagtcaaggagacccctctgccttctttctaagctaggtaaatgagaccctctcaaagctctcacatggtctagttcgcctcattagttaaaacactacaaagaaatttgagacagcaacagactttacacaactgagttgtttgcctatttcctgaagacctggtgggcaccatggtagaaaatagggcaggatttttttcaccaaaaaaatctctctaaaaggcaaccaacaggtacagcttaagccactggtgagtgttctcatctggaagtacatgatttaagcagtaatgggtttggtcactatttttttttttattctgaaacattccttacatgagatttttaatacaaagcctgcaaatggtttatcttgaggaagacctttactgtagtcactatgggatatgggatttaacagttgattgttggagatgttaaactatgctttctgcttctctattctctatcttcctcattcaatgataagtggtactagcagtggtgaccaaccacaggctacaaagaacagtaggccaaggtattgaaaacattaaagacctgaaaggatgctaggagaaacataagaatgtcccctcccttgctgggcgtggtggctcacgcttgtaatcctagcactttgggaagccaaggcaggcggatcacctgaggtcaggaattcaagaccagcctggccaacatcgtgaaatcccatctctactaaaatataaaaattagccgggcatgatggcgggtgcctgtaatcccagctactcgagaggctgagacaggagaattgcttgaacccaggagacggtggttgcagtaagccgcagttgcgccactgcactctagcctgggcagctgaccaagactccgcctcaaaaaaaaaaaaaaaaattccctcctttcaaagagcttataaattggaaatactaaaaatatttattcacaaatatttatgaatattatgaatattcatgaagctacagagcagccatgttccaggagcccaataagtatctgaacattcggttaactttctttcaatgacagccagtatctgttcatcagatcaacataaccaaaaggtagcatttatgaaaacaaggttttaagtgtcaaccctattaaagcgtaacgccataaataacttattctaggtttcatccccccaaggcttgtcaaaattcaaaagcctatatagtggcaaggccaagttcatggattctacctttaagacagtaaaattatcaccacgatgttccacaaatcatttgttatcccaatctctaccatctattttgcacgtcatcacacaaaggtcatacagaggacagaacgcagtagtatagatacatttcctctcagcactttccggaaaactaaaagcttatgccattactaaaggttaatttcttgtattctatttgagagtctatttctttcagaactaaagacaagatttacatgactcaaaagacaagatttgtatgactgtgaatcagcattataaaaacagcccttgcctcaaaaacctatactgagcaacacaaaacactgctttggggactggaagagatgataaaatgaggtgggaaacaaagggagtaagtgccttaagaaattttaagaatcatcctcaagaagactttacaaccaacctagaaaaatacaaaggtgcgaaccaacaatagaggtcgaagtgcagtgcaattagctgtccatcaggcagacagtaactactgtaactgttcatataaagatctggtttactataaagttttattaactttaatgttatgaaatgtctgtataaaatatgtagatgcgaatatcaaggcagggaacaacaaacttcagaaacatggttatttcaagagaaggatgcttggcaaaaagatatgaacaatttcacaaaactccaaatagtccctttaaaacacattttaatttgaaatttcttctgagaaatccttttttatcttaaggattaacagtaggcactgcacagtatctcactgcatcactgacaaggtattaacttcctgtttagtcgtaattataggtgaaacaagcatgcgtgttcattacacaaggtactaagaatggattgaatattactaattttctttcgatcaccactgaaggtaaagtcacttaacattattcaaagccattcttttgtaagcattatttaaaaatgggcaaagaaacccaaatttagatttgaagctctgctccatgaaagcaagaagggtgttttatggacattaaaacaaacaaaacaaacaaacaaacaaaaaaaacaaagattaacagccaaacagctgcccagtagtagaaaacattcgattacacattagccatgaaattacagcaaggttaggattaatgtaagtatttcatactgaaaaaggtacaagaaatcatgattcacaattgacaaacatttaaatacgacaaattcagctatgaaaagttgaaggtctcttttacaatagattatgttgaaagtatcattaggagataaaaatcagatgtttcaacaaagtataaaaatacttccctaaacttttcccttccctacataacaaggttgaggatacaattctgaataaatcttatctaataagagaaactgggcagtaagatatttggtgaatgcattcatttttaattatgaaataacactgctatggtagcaagctcaagaccacaacatttccaagaatggagagttttatttcattaatttcaaaatactggttttggcaaggggaattaagtcattataataaaagacaaaccacattgtaataatactagtacaaaaaatacagtatagaaaatttattttaaatacctcccctactagatctaatattcttgaaaggtaaattacaaagtgacaaacaactattcatgtgtttacatgcttattttcaccactgaacgcagagattaccatagataaggaccatcttcctcatttattccctgggactagaatactacgtctaatgcagattaggacctttactcccctgtatctgtggttcttaatcagagaggagcttcagaatcacctagaaaattttcaaaattatgtgtttccagggaaaatgatttagtaagtctaagacccccatgcagctgtatttttttttaaattctaaacaatctgacatttaaaaataagtaaacaagtataactggattgtaacacaaaggataaatgctcgaggtatataccccatttaccctgatgtgattatgcattgcatacctgtatcaaaatatttcatgcaacccataaatatatacaccaactatgtacccacaaaatttttttaaaaactccaaatgttctggaatataaatgtaattcatgtcacacccaacaatatataatattcagtaagctcttctatacgctaacagatacaagaaaactgctatttaaaaaaagaatgcaaaaaccaacctaggtttgagattttaatctgaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatctagtgacacagtagttcatcccagtgatggagcattcaactttttatttgtataaataacaaaaactagaatcaacactgcagatgagcatgatgaaagaaaagtatgcagtgtcagtaatgcatcctttttcaaattaaacaaatactgaggtcctattattatcagcatccttcagtcacaactatcctacacagaaagtgagctggctatcaacaagctttgaggaccatatatgaaacacatgcaagacagtttacccagcctatatactagttggggacaataaatatattttgttcactctaagacatcctaagcagttaactggcacatgttagttttcagtgcttgaagagactaccccaaaagaattaaatccacttctactttcaaaatattattagccaaaatcttaactcacaaattagctataacctaagagtaaagctaactcccaattacttagatgtataagtgggagagcaaagcagcttatttcaggtaacaaactaaaatcacatacattataaaacaggaattgaagggccaggccacgtggtggctcacgcctgtaatcccagcactttgggaggctgaggcgggtggatcacgaggtcaggagatcaagaccatcctggttaacacggtgaaaccctgcctctactaaaaaaacaaaaaaattagcctctactaaaaaaacaaaaaaattagccgggggtggtggtgggcgcctgtagtcccagctactcaggaggctgaggcaggagaatggcgtgaacccagaaggcagagcttgcagtgagctgagatcgcgccactgcactccagcctgggcaacacagtgagactccgtctccaacaacaacaaaaaaaggaattgaaatggttcaaaaaagagcttgagcttttggtgcctatctgatttgaatcccagtcacttactagttgtgtgactagacgactatttctctgagcctgttacttcatctataaaattctcacatctatcccacatggttgtcttgaggattaaatgagttagggtttagatgagactgcattgtcttaactactgtaatagataatactatatgcaaaagtaaaccgttctgaatgacaaaaaaaaactaaaggatgatatcaaactgtagttgttaagagcacatactctggaccaggctgcctaggttctaatcccaactgtcacaacatgaacctgggtcatcttcttaacctctatgcctaagtttttcaatttcgagatggagataatcttgaaattatctcagtggaagtggtggtaggagggaaacgaagatcaaatgagagttttttaaccctttacccatggtttccctgctagccgcttgcttataatcatatataaacactaaagtcatacttccagaaataaaaacccttacgaaaacttaacagggtgtatacaatgaaaacatgagctattcttttaggcttggttcacatatttatcttcaaacgtccctaaaacacatatattgtagtccctgtttaatgggagtggtaaaattgtctacagctctcaataccaatcaacttggagtgccacttttaactcctgttgtttaatagccctatttaagaccatattacagctcgttcaaataaagaatacaggaaaaaagttgattggtctaacagtcaaaaaacttactccaagaacacagctgaagcaaagtatacattcaaaagctcgatcaaatggactaaaggttaaaactattccaataatcatttcagtaaaatattaacgaggaatacagatatatcataatacttgaaatgtgggaccttcagacaagaataaattcgaaataggtacgtaacacaagcataccatactgacatcaatggctacttgaccccatatttctagaagaggtgcctaaaccgaagagcattccagttcagagctgtccactcactaaaattgttggatgtggaatgtttgaaagttgcctcatgtgattctaacattaacagctgaaaaaccaaaccacatgcacacgtcaaagtttctgtaagttgaatcaataatgttcacataaacactggtttttccaatatgccaagtttttatgttgtgtctatattacataaatcttcaaaatatttacaaaaggagacaacctggttaactaagagtactaaactagaaatcaaagttcttaaacaaaaacggtttttaaaaattataaattgtgatattaaaatagcagtaataactaggagtgtcatgtgccaagagcctgttcaaatttgcacattaatccatttaatcgtcaaaacaaatctaggaacttaaaatttgttttgttcactgctgccaccccaatgtctaaaacagtgcctggtacatattaggcacacagtcatttattgttcatattacaacagatacccttcttatagaggcacataaacttgcccagagctagaattctaactggagcatttctgctccaatgtttacactcttagccactgttatattgtctctctaaagcttttaaatcatttaagtggtgtcacagcagctgggtatgacctgtaagagaaaaaaaatcagaggccttcctttaacgtgttctgttccacatgcacaaaaagctatggatctggtactattccacattttagtggcctgaactaattccaacagaaaagatttttatttgtactgaatgttatgctctttgtgtaaaccacactgtaacatacaactaggcttctccaatatgttcctggcctttaaagtggtcacaaaaagaggtaattatttcaaaataatttttactttaatccttaactcctaaaaagcgtttcttcctcttttctttcatttcacaaagatttaaatttgtatttcgcataacccaaaatgacgatgttatgaaggcccaaaacaaaattcacgatttcatatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaagaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaggaccgatgtgaggccgaagccagacggcttgcttcccacgtccggggccgagtgaatacgtgtcaagcccttttccttctccttctcggaacagcaccttcttactaaacagatcggagattggaccaggagggcgggggagggaggaagatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgcc

SEQ ID NO: 464 - DNA, 40352 bp, Homo sapiens
tgaaagcagaaagctgtttattttctgtgacatcacttcactttgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgtaaggcccgtaagcattttgatatctaatttacgatttaaaaattccagccggtggatttggggctttgcatgtatttgtagaagggcatggagagagagattcctcttgcatgcttggccatttgacagtgctaacatttgctgcatttagaatttttgatttttttagctgctactgaacatgcttagatacccccagccctgaacattatcatgagaaacctgtagccgattcatttctcttacttcatctgggaaggaatagtatcgtacttcataaaatagtgtcaaaatagtcactgttatgctaaaccggattaacataaggtttgttctgtgtgtgtgtgtctctttgtgtgtgtctgtttgtttgttttctcttttttgttttctttcagatcctttgtgagatctggttttactgaaatctcagaagggagttttttattcacgccatcgctgcagctcttgtgagaaatatttatatcatgactatttttaatatggcatatatttggataagccttctagtaaaatgatctcaatattaattttgtcaaatgtgattctatttctgagaaaacagaatatccgtaaagtgagaggtagatgggtttgtttgcgacttcacaccaacagtgcaggttgattcttacaatggtaaatctgttaacctgtcatgctgtctactttaatggctatttatgaagttgttggaatcttgcaacaatgatcccaattccattccactattttactttcatttttaacttgggaacttgggttcttttgccctggagtttttgaattagtcaatacagaacccagcataacatatgcgctcaagatgttgtctccggggatctggggcaggctgctactctgtatgatttaccatgtggggaaaaaaaacacctcagctctttctaggtaattccttaaaatgttaattctcaagagactgttttttaatctcatctaatttataactagttccattacaaggagggaaagaaaatattaatataggatagtgcaaaggattactctctgctatatgttttgagttggccacaagggaaccacatactcagtctatgcctgaaaatattcaaaaaaataatatttgactaagaaatcagatctgttcacaggcataatggaacacataaaatttgttctgatgtgtaatgtttggcaattggagtcctagtccttacagcggtatcacatgggggtcaagaggtctcccaggactcaggtatcaggtcgcagacttggtttgtagctggacggatatgggcagaattagacaattgtggatcagctgagtcttggctatcttaactgcatgattcaggacccaggcctttcacttgtttgttttttatttttttattttcttgccttacttggccattttggctgtttgaagttacatacacagaggcaaacagcatggagtggacgttggagagacaagtgtttaaacctcaccctgccactcatagaacctaaacatgtagtcttgtgcagattagtatatctcactaagcctcagtcttcttatctttaaaatggaagtgagaacacatacttccaaggtttaagtagataaaacacttggcatagggtgtgccaaatgcttacacatttataaatggtagggtttaaaaattttatatcaagctaaaaagctaaaagtcactcatctattgttttgtgtatatgaaattcctaaactggtttgactgtttcattggattcacaaacttgatcagttgttttgacattatgtaatgatgttggctaatgcccttctactggctgatgtcttcaaatgattagcaattgactagatattcctaaggggtttatctgtttgattgatggctagtggtgtgactgggggaagtgttagttagcacatcaaacaaatccaaaaaagatagattctttcccacagaaaggggcagagtctctaatgctgggatccttccataggataagaatttgctgtctctgagaaagtgataaattgtgtttctggtcctcacttgttaaatgaataaatagctcttttaaaaagcatccttttgatatgctaaggcacctcccttcccctaggaagttacatagatctagttacatagatcagtccttaaaattccaggagtagtgtcagtagacactagatggacattagctgtggcacagaaagcctggagtgattaacctaatcaattaccacatctccactttgtttttgttgggtggacccagtcacggcaagcacagatgctggacaatgttatagaaatagttaccggctgctgcagggtaatgtgatttcacgtatttagaatcacagagggaagccaagggactggtttttaaatagcccaaccgagtgtgtgccatgcccgtgccccatgctccgagttcctatggaacattccagcctttatttctaaaagcagttcaggtttcagaaataacaaaaggcgagtaattctctcccagtgtgttctcggttaactcagattggctaacctcaacatggtagacttgtgccagagctgaacttatgcaaaattgtcaggggccaaagtttgtccctaatctccaggaccctgtgcctgaagactctgctctccatccttcttgcccaatattctctgcttccgcctatcctcaggaaaaggtctaataaactcatgtgcggtgtgtaggaaatatatgagaaggctctgaatatgaactatgaaacgatcataacaattgtgggaatgcatggatcccacagagaaagatctcttctgtgagacagggctgtccagtgccctgaaaaccccatatgggctgccaatccccctttggaacatgaagaccaatggcattggaccaccagattaggcctagatcacacaagccattgaggtttgcaatgaattccaacagcatttgtgattgtgaattgccacactcacccatcatacactgtgaagagataaatttcagaatcaattcggcttgattgacgtaggaagacagttcgttggtttcttgctttattgttgggaagggttaaagcaaatgtcctatttccatcatccaccctaaaaatctgataatgtcagtatgcccccagatgctttttcagagcttctgaaaaagctatgatgagaagtacttgttgaaatgtcagtctggggtactgaggaaaatagacatggtatctgaagttacatgcagtgtttgggaaaagatcctggtaggccatggctggcagtttgtgttggagaacaagaaaaacaaaaacccacattccgtagagaagagagagaaagaataaaattattcaataaaaattcattagattagttgtaatatacattttttaaaaatctcatttatgggtttaaacataacaataaaaacctttcccaagcaaatgcaatttcattcatgttttacatagggccagtttcgaaacataaccaatgacaacgattatgcgttctagcttgcttttagtgatagaaagtggtacttttagtgaatgcagtttagggaaatgtgttttcacacattacagccctgttccttctcaactacagactgaagtccccaatgatatgggctcatgatggaagtgaaattcaaatttaagaggacaaaatgtggccacttcgccacccacttataacatattttaattataaacccctgtaattcccgagagtgttctattttcagggagtgatttccagggtagttttagtatcatgctcaaataaaacaacacaaaacaaaaacactgcacgtaagaatccgacatgaccagaaaaaatttcttagtattccaattggatgtggtcttgtttgaaagacagaattgatctttcagggtcaaaggaggggaatagcgttattttaaaaattaatccacaatcaacacataaatacctgatccataagaaattaaaaactaaaaacaaatggaaaagcaaaaggcatgaacaaaagaaggaataagtccatccttactaaggctttatcatttagtccttcaaaatatgatctgtccaggaaaaaatatccatggcctcctttacctttaaagcaattgctacctttttctattcctccttatattagaagcctacaatttagcagtcttcaatgaccactcaagccaaacctatcagccaagggtgtttttggaggaattattagctggttataggtgagcacgttttggtttgtatccagctgatgcccccatgatggaccaaaaagcaaaaatttcagtcatctaggctgttttgtctacagtttgcccaatgatccatagatctaatctttaactttttaattaattacttcttttttgtttttactttcttaaaaataattttaaattttattttagattcgagggtccatgtacaggtttgttacttgaagtgaattaattctcgtaactgcacaaactagcactcaccacaattgttttctctgaaagtgtatttcatcctttcagttattcaggcaagaaacttcagagttacctgacccctctctttcactctccacttccacctggacaagcatcctgtccgacagcatgagaatctgcctcctcctcttcaccacagcaccactgctttcactgaggctgcatttcattcactgtttcacaggctgtggcaggagcctccacgcctcactgtctgctttcagttcccatctgacccatctccattagcgctgcctttcctgagacacagctctccgtgctttcatgactccctagaaacagagaaagtccagacacctgagctggcatccatagtgtttggccctttctatttgtccaaggttatcactcacatcattgactctacacacacagacacacacacacacacagacacacacacacacacgtgcccaaacaagttctgcaggatctcattctatgacctctgttgattctcaaattctctagactttactgatgtctggcactgtgtgccatttgctagagttatggtgcttgtatctgccttgtgtctttcatggaggatcaccaataaactgtggtcccagagaaaaacccagacatgttttcccatgtatttgttgaatccagtttatgtttccatcgattttgtgctgaagactcctgtgttactctcagcagataatgctggtcatgttcacactctttctgatgtttggtgcaccctatctgaattcacgtggactaatagtgtggaggtctgggaagtgagccgaactaaaaaaactcgaggagatatttgctcatgaagttgtgaattcaaacttcctcagcagagatttccagcataccagatttcaaaggcaaagcatctaagcctttccttagacccaccgctcgaatctcttgtgtcccacgctgacttcacatttggtctccttggtttttagtcagactgcagaggccgactagtctgtcctgggaagggtaagatgctcctttatccagcctgaccggacatccagagggaaatgttagttaagcattattaatatgaaaagaaaaatcaataacacaaagataatttcctttttgatttaagtactgcttagccaaaataagtatttatttattgtatagttgcaagcagcaacaaaatgaaaacaaaagcctcccattttagcagacatgttttgaggctctactgggtagcaggtacaatgttgggctttgtgaaggacacaaagatgagtgacacgctgtcacttttcaccctgatatggcagctccaagctggtagtgattcttgatatggtaaattatactttgcctgtatttgaatgcattagtttcatttaaaaaattatttttatgtaagtagagatgaggtcttgctatgttgcccacgctggtctcgaactcctggcctcaaacaatcctcccacctcacccttccaaagtgctgggattatgggtatgtgcctggcctccttaaatgtattataaggtagtcttgataagcattctcattttgttcaaaatgagattcagttgattagtgatgatggtgatgcttgctggttgttgatcctgtggctaatacgggctacagaatgtctgcaagggctttacagcatcagctgtaatatcaaaacagctgaccctggtgagctggcaatgaggcagacaacacagacttgtgggcagataagcatgggttcaaatccccactctgcttcttcctagttgtatgatttggggcaagcttaatcaagtcttgatatctatatctacaaaatgaggaagaaccgtagtacctattgcacagaattacagtaaggattaagtaaaacaatgcatgaaaaatgctttgcaaggttcctgtaactcaatacacattagctttattacagtatctgaaaatcactttaattggaactaccataacatcagattagtgtctgattgtataatctgggtttgccgataatctcagctttaaacattttgtggttctacacacagttccccagcagaacttgctgagaaatcttttctttaaatacttcttacaggaaacatgaactatttacctttcaaaaaaaagtcataaccctctcctttcttcctcatgaataaaatgactggcaccacgttttgtaaaacatgccagattttgtttaaataattaatattggcagtcttcagatgagtggttctatggtagcatagaaagaggcctaaactagaaatcaggaaacatgggtttgaaactcagtttggccactattgggctgcgtgatccaatagtttgggtaggtcacaaaactacctaatagtttgggtaggtcacaaaatatcactggacctcagcttttattgcataaaatattagaggtagattaaactgtggttctgaaactcaaatgctagtggggtttggggcggtaagaccaatgaaggaagcagttgagtataagacaataaggagtagtggtgactgaggtaaaccagagaagacatgtcttacctaaaaatcctctgctccaactgactattgctgatgggattgtggtacatgcacatggagccctatcttcctcatttttaggggaaggtggaattctggaagtagatttttaaacaggataaagaccaaacaaatataagttggcattttgagacccttgcattcaattacatctaaggtctcctcctatcttaaaattctgttgtattctacaaacagttacgttaatataatatagaaatggcatggttaaagaaatggacaacgatggcttggcgcggtggctcacgcctgtaatcccagcactttgggaggccgaggagggtagatcacgaggtcaggagatggagaacatcctggctaatacggtgaaaccccgtctctactaaaaatacacaaaattagccatgcgtggtggcgggcgcctgtagtcccagctactcgggaggctgaggcaggagaatggcgtgaacccaggaggcggagcttgcagtgagccgagatcgcgccactgcactccagcctgggcgacagagtaagcctccgtctcaaaaaaaaaaaaaaaaaaaagaaatggacaaagattattgaatcagttctaacaaaccaatacattaggttgttcattgaaagaaactcataatatgaaactggctgttataaggttattaatacaataattgtagttcccaatctcccaaacaggtccaaagggaccttaccaggctctccctgtggtggttgatgataaaatgatgtttcagtatccctctcatggagcaaggattggaaaaaaattgttaggcccatttttatatagcaagatggcaggtgcttgcatgtgtaaaatgtgatcaaaaggcaataaatctttaaaaatacaaactagaatgtatacatacaaataactcttgacttcacagagggccatagattttgcccaactgtgcttccatggctaaagatttctggaccctcctttgagaattgtcttcattgccagtttacaagccacgcaataaaaccaggcaaggttttattagagacattagttatttttgtattgcttggtgctaagcattttatagatctcttttttttttgagacggagtctcgctctgtcccccaggctggagtgcagtggcgcgatctcggctcactgcaagctccgcctcccgggttcacgccattctcctgcctcagcctcccgagtagctgggactacaggcgcccgccaccacgcccggctaatttttttgtatttttttagtagagacggggtttcaccgtgttagccaggatggtctcgatttactgacctcgtgatcctcccgcctcggcctcccgaagtgctgggattacaggcgtgagccaccacgcccggcctatagatctcatttttaatgtcatcatcatggtaaccttttgaggtagatataattatctccattttgcaaatgaagcgctgagtcctaaaagataacctcctcaatgtcacgcccctattaagtagcagagttggagtttaaacccatgtcctcacttttaaccacttctgtctacttcctcctgaacatgaatcatcatgcttcactttgcatagttttgttcccaaaatcaaatcccctctcaaagggtcaacctttgccattaacaagagttttcaggagaatgtgccctaattcctggagacaatgactgaaaggagtttcaaaagccctttgaaagagtggccgcattgctggcaagagcagctagtttccctaggttgcaactctcatttatatgtgtaagctctgatctccttgcttaaacaaaaatagagagaaagaaaagaaaaaagcaaaagaaaaaggccttatttactttaaagttacaccttagactactgttgtctaaacttgtgtcctgtggagcagttgacctgaaagaagagttctgtgctcaaataaatttgggaaactgcacgttctatccctgcttggttatttacaatgaagttaccttggcatagaaacatctctgaaattattcaaaattgtttcacttttcttaacatcccatagaatattggttctatggaacatacagtactttggaaatatatgcatgtgataattcatcttatttttagcttaactatttgtaccccacctcattctagagaggttggatagcaaaggatacgcaggtggaaagaatctcatcctagtggatacattaaacggtctgtctccatataaggagcaactcaagaccattttgttagtgtggattcgttgatgtgacctctgggagtcaggctcctcagtaggctctctacctggtcaagcaatttagcacacaccccttctttagggacctcccagtagatctccatctttgggaggaaggagatgacttcttgcagctcattcaacaggaaaaggcttctgagtgtgtaaatatacactgtcactgtttttatttggagcagatttcatcacagctattttctaaatggctaaacaagcatttccctgggtatgttccatggaatattcattttgtaggaagctcaatgataaaagagtcgcattgtcaatgagaccaggaaactgtatatttaattccattttgaagagtctcaatttacttaaggatagaaaaggcacagttaagaaccctgattaacttctttaacccacttttcctaaatgtatctgccagtttttgtgtacataaacctctcaaccctttgaagatcgtgcgttccagggaatacactctgggaaattctgggcaagactgttgcaggtttgcagcagatactaggcagagctgatactaaaaagagggagctggcttcctcatggccactcaccagtcctggggaagtcggggagggagagaggaagcctgagcctggaatcccagctctgccacttacaagcttcaaatcacttcacctccctcacctcggttttctttatctcttacgtggagaatataaaacctacatcttagtattcatttgaggattaaaatcagatgtcaagctgttgaagatgaggcctggcatggagtagacccttctccttgatgttccaggactggggagatccagggtgattttataaacacatggggagggtgggctgctgactagctgtgccaattcctagaaaggaagagtttccactgctctgggatgagagataatcccaggaggattgaggattaccaaaagggggttaccactccaaaaggagagggtccatgctcgaatgtttgctagtgtgcatgtcaaggacatccctgcaaatctgaaatccacatcctaaatcctagccccaccactgacaaaagatgtgaccttggttaagtcacttaacctctgccagcctcagtctcctcatctgtaaaaagaggagttggactacgtatctctctggagtacccccaaccctcagattagtgtggaaccaaattaaggttattccaatcaatccaggttgaagagttggtaatctaattaaggatcagctgaattttcaaggttgagagtcaaaaagaactgtcaaataatgtacttgtgtgtgatgcttccaattttaatgcttttctgtgttaggagcatatttttaaatattcaaatgtgaattattcacatggcacatgcacttataatgtgtgcatttaactaaagtgaatcatcagcctattattaattatcatttaaccagccctattcttttggataaaggagagtgttagtaaaaaccaaagggtttggatcatttaagcaaagccagctctaagcaatttggcaagcccctccagctgtccctccatatcttccaacagctataacctgtgcatcctgtgctctttcatttacatatacatatacatatgcaaataaacccatgttcacttgggagtgtgcacactcatgtttgtacacactgtccgtgtcctacctaatatcctagatgtccatcaaagtcttcttggggcaggtgacatcctcacgggacctgagtttccttagcagttaaacacgtgttcttttcctagatctaagtaagagctcttccagctctgacatttgatgtctgtgctctttacttagctattccttggcagaagcattggagacatgctcatacacattatctcacataattcttaaaatcatccaggaagtctttttgcatcctcaatcctattttaacagatgatgaaacagatttacctacttgatgtgtaaacatacaataataactggcagttacaagcttagaaacctgattctctattctgaatccaatcaattcattctccaagtgacaaccaggcactggctactcacttttcccttcttaatcagagtggtttttgtggagttgggaatcatctggaagagcctcctagatcatctcccctccatagccaggaaaatctgctctaggctgaaacatgggatgtaggccactcatgggccagatacaattctaatggcaatcaagatattataggtgactggagagagtctgaagaagtacatgtcattagagccagggtgcctggcacgggaccaaatgagcagtctagtttgagacaatgggaagttttcttagcaggagtcacccttcccccaaccattcagccatctgcagaccagcctccccgctccccagattccacatgcctactctttcatgaatgaaggctacagtgctataagcatagactcacacatctttagagctacaaaagacctcacaaatgatctagtctagtctcctcgctttacaacatagagaaaagtggtatgctctaggacacagaaggtatggtcaaatttatattaggcttcctgattcactcttcagtgtgctgcttccctggcctctgaagaggcgaggccccagggcaggaaagcacctcagtggcccaccagacttagcaccaacacatgagcctgcccagtcctttcgctcttatgcattcccgtctctggcctctcacccggtatttgggcagccttacccttgaccccttgtagctatatcctcattcttagatcctctgcttcttcatttacttctctgttgctggccctggttccctctgaactctgagctccatgttaaccctgttgcctacttttccgttccttttgaagtaaattctgtgtgtcctacctctccgttcaaccaggaaccccctaatagctttatgaccttggtgtgaaagtgtcacttagtcatgacccgtccctacagacagcagaatctggaggaattagagcttaatgttagcattttacaggtcacatcctctgatcccagagcaatattaataatgaaattatgaaagcttttttttaaaaaaaacaattacaggcaattttaagaatattattctaaattcccattgaaatcaaatacgcaattttaaaagatgagtacagagcaaaacttactggatgcattacacaaagtaaagttccatttctaaatactttcattttttaatcagaaagaataaaagtatattattgagcactaaacttaataagtatcctaaggaaatcaggagaaaagcaataaagaaaagataaaataataaattagaaaacagtgggaataaaaaaataaatcgaagatttgatccttggaaaatgccaaaaaaaaatgtgccagacatttgaaggatatcacatactcaaataggggagattctgttaattctgttaattattcaacagaaagccttgggtaaatttgggtaaatatttagaaaatatcaaggctgtgtcttacctcacatcatacataaaagtaagtcccaaatgtattgaagagttaaatattaaaaagaaaatgttaaggggaagatgtaggcaatatttccttgatctcaagacaggaaaggatatttaaagaatgaaatcatgtcttttgcagcaacatggatgggttggaggccattatcttgagtaaaataactcagaaagtcaaataccgcatgttttcacttataagtgggggctaaataatatgtactcatggacataaagtgtggaatgatagacatgggagactgagaagggtgggggtgtaggaggaagggagggatgatgcaatacttaacgagtgcattgcacactattcgggtgacggttacaccaaaagcccagacttcaccactacacaatatatccatgtaacaaaactacacttgcaccccctaaatttataatttttttaaaaaaggattaaaggcaggccaggcgcgctggctcatgcctgtaatcccagcacttgggaggccgaggagggtggatcacgtgaggtcgggagttcgagaccagcctgaccaacatggtgaaaccccgtgtctactaaaaatacaaaaattagccggcacagtggcacatgcctgtaatcccggctactcagaaggctgaggcaggagaatctcttgaacccgggaggcggaggtggtggtgagccgagatcgtgccatggcactccagcctgggcaacaagagtgaaactttgtttcaaaaaaaaaaaaaaaagattaaacgcaaagaaataatacataataggagttgatgtattttgttaaatacaaatttaaacttctatatgttaaaaatcattaatgaaaaggcaaattggtaatcagtaggaaaaaacttttagcatcaaaagaaataggaaaagatgaagtaatatccttaataaataaaaagtgcttagaaagcaacaaaaggggtcaaaggacatgatttcatagagaaataaaaatgataattttaaatgttggtgaggatatggtcagataggcatttccttactcagagttggacatgtaatttggtacaagtcagcagtaaagaactagagatttaaaaaccttctataatctaataatggtacttttagaaatctatcctaagtctatcataaggaaataagtagagataggaaaaatatttatatataaggatggttataatcatgtttataatagtaaacattggaatcgataatttaaaaagttacatcatgatatatccataatacaaaacttactcatctatggaaactatatttttgaaaaattgattgtcatgagaaattgttcatgatataataagcaaatgaaaagaaggatacacaatgatataatattacatcaattttataaatacatatgtgtatatatcatatatgcattatgcttatgcatatcagtgtctttgggtagtatgattatggtgcacttcattttcttctttaagcttttgtgttttccagaatttccacaatgagcatatattatttataaacagaattcaccaaagtgtattcaaggctgggtacggtggctcatgcctgtaatctcagcactttgggaggccgaggcggttggaccacttgagtccaggagttcaagaccagcctgggcagcatggtgaaactccatctctataaaaaaaaaaatacaaaaattagccaggcttggtgttgcgctcccgtggtcccagctacttgggaagttgaggtgggaggattgctggagccagggaggcggaggttgcagtaagccaagatcgcgccactgcactccagcctgtgtgacagagcgagactttgtcaaaaaaagaaacaaaaaaaaaaaaactggaaaaacctcacaaagcgtgttcaaaattttcaaactttctacttgaaaaacacagattgatattatctggatgtgattttaagactgcttactctaattaattcctctaagaaaggcattattgtttaattacatttcttaaatccgtatgagctgagtggtgttattatggctgctcgccagaacgtggttattatgccattatgtgacctgggacctgtgctgagaggccacccagtgtgtggaaaagggtactgaaccaggggtcttgggccttgcgacctcaaggaaagtgtttggtagccttctgggcctcagtttcctcttctgtcaaatagatcttacctgctttactactttcacagaattgtctaaagaccaaataagaaaatccaggcaggagtctatgacatgtaggctattatgaagccaaagatcattattcaaagaataagctagtacctgcctggaattcatagttcatataaatgatttttctaaatctccctcttggtaaggaaacatactcccgtggttgcagaagaaaaaagcctcccctctcctcccacagccccttttcttactgaattaataagtgcacagccctttggggagggtgtagacagatcaggcacacccctgtgtccacctccaccaaaattctaggggaaaatgcctggcttcttaggaaaatgcttccctaaaaaaagaggagaaacctcaagtgttcccatggaactggggcagagggcaaattccgcacaacctctgcacaaacccacgggctggctgcttggcaggcctacagggtccagatctctgatctgtggctcagagtaacgaggtcatttggatggtacattggtttcataaacccctccatgatgctgctgctgttgtgaggatagttgtcacttccaactcatattattgcagactctaggctacacgtagttatagggacaagaaagtccacagctcctccactccccacaccaacggctccaggcagacttgctgcaaggagcagagaccccttggtcaccacaggtaaaggggacagtgttttgactgacttggcaagcttaccatgtgcaaccctggctgcatatgagtctcctagggagctttttagtaacccaggtgacaccccacgtttagaatttaaccagaatctccaggagtgggaaccaagtatcagtatttttaaagctgtctgggtgattccaagagcaagcaggattcagaagcattggctcaggtttcaacacagatctaggtatctctcccacaccagtcttcaaaaaacttatcttggtgggttttccaccacaattctacactctcctaagcattctttgcacgtaattttacctaccatggatccaattcaaccctaaggcatcctttatcctttagcttctctaccggctggctccatttctcagtctgccaattccagatccccaagaagggtgtcgtcttagcccaactcacctttttaaaccaggctacttgggccatgggatgctggttgatttagagactggctactctgtggaaagggacagaggttgtgcagtgtagaacacggccaccctggtctgccccagttctgttttttgtgtaggtggggtgggttgggcacggtttcccttaacagagactgtggaatactttaacatatctggttcaataacaaattataataatgaaatcaaacatatttagaggaatccatacaaattaagggtcagagtttcatcctctgtatagaatatgatgtaggagtctttttaagtatacgtaggataataaaatggatagcccactcaactatctttagaatgtatgtataattttatacatctttttccatagaaactacaattgaatttagcattgagagattatggtattcattattatcttagccagagggtgtttttttagcttttataagaaacttttaaattgaagtataatatacataaagaaaaagtgcacgttataaatgtacatctcaatgactttttacaaagtgaatacccttgtaaccagcacccaggtcaagaaactcaatattatcattaccccaaaagatgccccttgtgttctcttccaattactccttgcctccaagggtaaccactctcctgattctagcagcatagattagtttttgtactttatataagtacagtcatataggatgtactttattgtgttttggctcctttccttgaatattcatccttagttttgcatatgcatttgtagttctcaccagaggttttagtccttgaaatgtagttcaacaaacattattcagccaggaactgtgcccggggctggggacaccaaaacaaataagggcaaattcctgctgtaagaaatatttaatccagtagtctcgtaatgatcagaatttagtgtaaggtgaattcctctttgtccaacaaatatttattcagtgtccactagaggacaggcgctgtatcacaggtgctagggataagaaatgaacaagcagacaaaaaatctagcagaaatcctctcttttcttcccgtgacgtgcatgggcaagttctgcccactaatattcatttcccactatgtcctgcatctgatttaacataaagggaagtagcaatggaaactatttcttctggcaacttggaatatgagaagtccctggtccttgggccatttttcaaatcagtgagtgtgggaggtataatatttgtgtgtaccaatttcttccttattccattctctccactgctgatgctgcctatactgaatgcaatgaaagtctggaacctaaggaagcctttgggtgttagcttaccttggagtcaagctgagcagtcttcttgttttccagagccatgaagtgagaagagacacaattgccaaagctgtgatggaaatcatacagctttgaatttgttttagtaacatggaattctaacatgtgtcactgttcattagtactggcttttcagagcctcgtgaattacttgggtacaaatccatgacattagaggcatgagggattagaagacaatccaacaccactctaggattgatagtttaggaagaaatgcaagaaatcatctcattttgtttggttggttcattcctaccccccattctccacatttttatgaaaaattttaagtatatataaatgtagacaaaatagtaaaattcactcttatgtatccatctttcagcttcaaaaatcatcaactcatgccaattcttctctaaccccttgttgtccccctcctctgattatttgaagcaatcccagatgacaaataaattactcataaatgttcacaaagtgagatctcctagttttaattcctgtagttcacaggttcagcggtgaattcactaagctagttagtggtacttatatttaatccctggcttcagaagtaaaagtgataagctttactaacagaattactattattattattacattatgacataatataatatattcttgtactgtttggcctaaaactacctcttttaagcctctcattcagttctccaaggagttcaacagggtgtgggatggctgattgatgttctttttcatcagtaatttctaaaccaaatccttgtggattttgaaattgcaaatatatttgtccaagtaaaagcttcaactatttggtaataaaatgggtctaagactcttcccaaacctcatgtttcccattttcagtctgtgtgcaaaggaggaggttggctgttgttcatggagccagtgtcaactgcctgtctgttacgagatgtcacagcacaaccaggcatgcagcttacttttttttaggtttcccaggctcaaaaccgcaaagtaccattgtttttgccagttagaacactccagaggtttctagaacaagcagaaaagattgttagtgcctttgtcatgaaaatatgtaaaatgttgctttggctgctttggctatcatagctgctctgattgtatctcaaaatgtcacccagggtatgtggcagtcattgtgaggaatcgggcaccaggcaccccttgatgagcctttgatgaggagatgattaggagtaaaaaaatgctgcatagattatctgcataactaacactgtagcagacagccatgcagacatttttctgtatacaactcccactcatttttctgagagataaaagcagccaagattgacaatctgtcagtttcaccattttcattgtgtactttttctgggcaggttattcacatcgaactcctttgatgtgatcagtgatgatgcttttattggtcttccacatctagagtatttgtaagtaaaaaagcttttttaaaacatgatgattcaggacaagtactctcaagttcctgtaactgtttgacaaaaaatattataacttattgcagattcatagaaaacaacaacatcaagtcaatttcaagacatactttccggggactaaagtcattaattcacttgtaagtatgaatgttgctattactttttaagcttgctaatggacaatgcagtttgatcacctgtggttaatgcacctactttatgagtgtccataaaaatttaagaaacccaaatgacttctctccatgcacacttgccatctttccctgtcatctgtcagagggtgttcaataaattgattactattaatatttttatccaaaaccaaccacaattagaaaagcaatctaatgcagggaaattgtgtgcctgaaataacttcttttattatctacatcattacttgcttcatggatcattatgagttgactgtataatttgatatcagctttttttccctctataagccctcactttatatacatttaaacataatatagccacaggcgatgtcttcatagtacctgatcaacttgtttatcagtgaaatatttaattactcaatggatgattacagctaacagcagttgttcttaacagggaacaattttgtctcccagggaacatttggcaatatctagagacatgtttggttgtcacaactggggatgtaaatggcatctagtgggtgaaaggcagggattcttctactgcttaggacagcccttcacgaccaagaattatccagcctaaagtggcatcgtgggcaggttgagaaaccctgaacaacaggacccaaacaatttgtttcttctagcctccctcaccctctacagacaaacacattcacacacacacacacacacacacacacacacacacacaggcacacatgtgcatacacacacacactcacacacacactctcacatacacacagattattttaaggaaactagaagagcatggaaagaaaaggcactaacatttacatcacttttcatctaatcctctcaataatcctgccaaacaggcacaataatccctgtttcagaaatgaggaaacagtcttggaggggatatatgcctcgtgagctgattagttacggaattatgagaacatctacttaattgttgaattgcagtgactcttcatcctttcaacagctatttctcaatctacctaatatgtatcttatcagttctagatacagatgcaagagatccaagtgtcatagtcattctgtcagctttaacctgttctctcatcatacttcattcccagctctgctctaggccctaggatgcagcagggaacaaaggagacaaaaatgcctgtccttggactgagcctgatttccagtgtgtccacgcggttgtcactctgcctccaccaggcccctttctctcctgttgcttgttttgtagcaaagagaagctaatagccagatatattttacaaaatcatgcctttcaaggcttctgtatagagttattgtaataaaaaaacagtgtttgcaatactactcttcatgtcaatgacatgatatgatgcaaagatggctgtttacagaatgaatgctatgcaattttatcacagagctcaacactgccaaacctcatttttcagacaacaaataaacaaaagaaacaaatatatggaaggagaaatggaaattcatgacctcaacttgaaatccactagattcacatacatcccaatccacatggcctctgtccagtgcttagcatcatgagagctgtagggaggatgcacagcccaattcatccagctgtgtctcctctccagcctaaaagcctgtggtttctctcaggctccatgcacagaacaggaaaaaatgtttccctgtcttggaaggaaggagggaaggaaagaaagaaggaaggaaggaaggagggagggagcgagggagggagggaggggaggggaggggaaaggagggaaggaagggaggaaagaggaaaggagggagggagaaagaaaaagaggaaggaagatgagagaggaagggaagggggagaaaggagggaaggggaagaggaaaaagggaaagaaaaagtctgtttgacatcctagtgtaggacacccattttgtttactggagcctatgatgtgtatcaaatgaaatgggaatttaaatatgggtcttaatgatgccctttctttagcagtatggagcctgtaagagagagagactgatacagaacacgcttaacattcagaaaatttcaggttcgaggaacaccaagggcagccttcaaagagaggcatgactcttaacaggcagtgaaagagaagtcccacctctctgagctggtgctggaggtaggaaggtgttatgagggaacaggggttaaggctgtggctaaatgaatatgacccttaggtctcttgtatctttagctaacacttattaggttgactgatacggcattgccaatgttaggctgttttttatctacaaaaatggcaatgccatatggttcatcttaaatagtttctaagatgtgacacatgctttacaaggagtagggcctacaaagatgagtaagatctagtcccaccttagagaagctcaggctagcaagagaaattggacaaatattttctcactgagtgcctttgtccccaagttatgttctcctttcaaattatgctattcttcatggtacaattccttccttccatccttcattctttccttcctttcttccttccttccttcttttattccttccttctttcctttctgtctttcaaggagagatggagtagggaggatctgaaacccaaatttccctctgccggctcagtaagtcaggttcattttccattatttatggcgtattaataaatctggcatttgtctgagccattagtttcctttttaagacattaggcttcaaagtgcacttttctccacctcagatcaatccttcccaatcaaggcaaacattcaagctgtgaggaattagtacctcaccctctaacctgcatgcattgcaggaagaggttacaaagctttctcatattcttgacttcatcatagtctcctgacgaccccgtgaaagagacagggcagtagcactaggttcatagatgaacgagcaagtggaggtataccatgagttgaagctgctccccagttactaagtggtaaagccagacagctcccaccgtctttgatgagacgtccagtgctacgtccactgtgccagttaccgcaggaccagatagcttttattgagctggctggatccttccatgggacatgatttgaggagaaaatatgactagagaagaaagaaaagatcctgaaaacaggaaacctaccctcatatttcatctcaaaatgcagatagttgggattagacgtatactttcaggtccagctggttcccactctggcctaacattaaagccactcccttacctgcgcctttatataaatttagttcacgcctaagaaacaatgcactttctcaccttcttatacagagatgtcagtagatttctcttctaagagacatttacagataacttaaaagttattataggccgggcgtggtggctcacacctgtaatcccagcactttgggaagccaaggagggcagatcactaggtcaggagatcgagaccatcctggctaacatggtgaaaccccatctctactaaaaaatacaaaaaattagccgggcgtggtggtgggcgcctgtagtcccagctactctggaggctgaggcaggagaatggcatgaacccgggaggcggagcttgcagtgagccgagatcacgccattgcactccagcctaggtgaaagagcaagactccgtctctaagaagtaaataaataaataaataaataaatataaaaaagttattatatatacctggctatcaggcgagatcctcccctcccctgcaaattaacccttaaaaccctgcaaattaacccttaaaaagggagagagacttcttaaagttaagtcctttcaaagcctgtcaaatgttgggattctcaattactttgttttgaatcattgttctaatgttatgcatgtttcactttaatgtttgaatggtttgtatattttagtaatcttttgtatatttgaatttttctgatgaatatatgttattttggtaatcaggaaaacatgaataaaaaattagtttatgaataaaaaattaatttatggccaatgatgacaaaatcttcaaacattatgtattggcttctagtaatacctatgagtctttagtaatgattgctttgtgtgccattaagtgtcactgtggctaaggcccagtggagccagcattgtttgcatgcatatatataaatatttggagaaaattatcatcaatctatatgtattgtagagtatccaatggttgctcagcactgagggggtacaaaggactatataacagtccccaaactcaggatgcttgtgtgttcccaatcagttgcacaggatgtctttgttttagccttcacattgccttatatgtaaagaggtagtgcaatgtagcagctaagagggtgatctctgccaccagactgcctgggttcaactgtctctctgccagctcaataggacaagtttattttccattatttactacttattaataaatctggcatctatctgagccattagtttcctttttaagactttaggcttcaaagtgcacttttctccacctcagatcagttcctcggctttgcaccttaacagctgtggaatttggggcaggccatttagcttcactatgctacagactgggcatgtaaaatggggttataataataatctcttaaaatgggatggggaataacaaggcatttaagagtattagtgcccaaggttgtcttgagattaagtcagttaataaatgcaaagtgcttagaacagggcctggtatgtagtaagcaccactgtataactaaaactcactgcccaacctccattagtcctggatcagaattctaaatgctatagtgtatataccatttaaacattttctgtgaaatttaagtaactacaaagtgctcagaacagggcctggtatgtagtaagcaccactgtgtaggaaaaaactaaaactcactgcataacctccattagtcctgaatcagaatgctaaatgctacagtgtatatcccctttaaacactttctatgaaattaaagtaactgcacttgcaccgccgcaggttcagagagacacaaacccaagctgagaatctgcattgcaggggggctggtgcaccccagatggctgtgggcgatgctttcttagcagcagagcccggtggcactgaaacaaacgcggtgtttgagccagtctggtctgccttagagagaagactttccagtgggttccacagtcacaatcggaggttttcttgggtaaatgatgaaaacaccaaagggcaggaaatggtcatcatttctgtgaagaaggaatggccgtctgcctttgagaacacttgaccttactcagccagtttcaaggtaactagacattcagctgcgcaatatctcagttgttttaaagaatgtttctggccaggtgcggtggctcacgcctgtaatcccagcactttgggaggccgaggtgggcggatcacaaggtcagagatcgagaccatcctggctaacacggtgaaaccccatctctactaaaaatacaaaaaattagctgggcgtggtggcgggcgcctgtagtcccagctactcgggaggctgaggcgggagaatggcgtgaacccgggaggtggagcttgcagtgagccgagatcgcgccactgcactccagcttgggtgacagagcgagactccgtctccaataaataaataagtaaataaataaataaaagaatgtttcttaggtgaactttgaaccaggacctagagaatggtgcttagttgaaggcaactttaaagagcctccacgttgccttgggatttctaccacagtggggctgtggggagggagggtccttcctgaggtgggggtccacaccagctggtggggactgcactagtcactcacagggctttgagctttctcccccagtgccttggcacagggggcctcaaaggagcatcctctgctcttttctttgcctagatatgtacgcgtcctctcgtctactccagcctgcctcattcattcattcatttaaaagtatctattaggctgtgtgcggtggctcatgcttgtaatcccagcactttgggaggccaaggcgggcggatcacttgaggtcaggagttcaagaccagcctggccaacatggtgaaaccccatctctactaaaaacacaaaaattagccgggcatggtggcgtatgcccgtaatcccagctacttaagaggctgaggcaggagaattgctcgaaccagggaggcggaagttgcagtgagccgagatagcgccactgcattccagcctgggtgacagagtgagactccatctcaaaataaataaatacataaataaataaaagtatctattgagggcttactttgtgccaggcactatgctagcactacagataatggaaagagaaccatccttctagtactcattgcagaattatcctagaaataaaagaacattgattaaatgtttcctcaagtctctcattgactgtgtcttcacccctctcccaatcggctccaccccaccccagtcagatattctagtgccacctagtgtgacctccatgccctggaaaagcctgttgtcaaactcactgacccctaagtacgtggcctaaagtatcacctatcctagtgtcatctattaattttaaagatgaagccatagcctctcagtgaaaatgacaaagctgtgatttaagagcaagaataggacttggagatcattctgacccagtgatcattcactttatagaaaagggaatagcctgagctcaaactcagatatccacttccctgtccacgtcacccctgtactctgtggctgagttctgggccctaaagtgagtctgactggcaaggggtccactttggccaacacaggagcctggtactccttaaaccaaaacatgtagaaagtctttttcctgacaactctggtggctacctgggactccttgcctctctgtccttcataatttttcttcctcctattcctaagaattaagaattcttatatctagtattaaaattcagctctgcttaacagctcttggctaacagatctttgcagaggaaggagggtcccctactgcaattcagggtgacactctctcaagtcgtgacactctctctagtcatgacactctagaggaaagagaaggactagacactctgtgggccaggatccataacatgatgttccagaatcacttgcttttgatgggctctgtattaatggctggaagaaaacatgactaaatcttaacagtggttacttctgctatgataattattatttctctccttttttaaaaaaataatttttgcactttccaacttttcttgaagtgaagaaataattattattccatatatatgtgcatatgtagtgtgtgtatatgtgtgtgtgtgtatcaataaaagtaaaagatgggacttttaagaataccaatgcataggattatccctactaagagaggcagaaagaatagatgatctcagcttcctgaagcaaatattttaaagtgtttagatatttaatatcactgtttaatgacaataacaacaaagaaaaagattagttttgtggtcttaacacataaggtttaaaaattcacctgcagatacagtttttcctggaatccattacaaagatatgtatataaaaatattagtagctacatgtgttaattctcacaataagtgaaattcatatcctttactcagttttgcagatgtcaaaacagaaacccagagaggtgaaattaacttggctaaggacacattcctaagagtgatgacgttcaaatttattccctggtggatttggacgaagttggcacttaaaccactatactcccctaagtgatgcaggaaagaatagctacaaccagttttaaaaatacttagcacgtatagcaactagagcttctgttgaggaaaagttaataataatattattatatcattactctgtgaagctgggagtgggatgaagacagaactgggaaaattttatccaggtattttgctttctggtagcaaaactcggtgcagaggtggaatctgaagaatcaaataatcctaatatcaaccctaaaataaccctaaccctaacccacaaagtgctatctcagtctctctagctgttaaaattccctgatagacacaggatctcattctacttaccccttttttaatgactaaatgctgaggaggcttcagggaacgtcgcgtgacttgccctttttttttcctgttgcccctgagcccggtgccctcagcagccctccgctgcagcaaatctccctgaagccctcagatgcccatgatgatttgtggaggcaacaggccctcatcacagctggctttaagctggcgcaaagaaccacagcggtggcttcaagcctcggctgccctgtagccccaaacctccctaaagggtgagggcctgaaaccgcatgagagttttctaggaaacaggcagctccccgctgcaggaggtcttgtgaaagacatttgcatgacctgaccactcaggcccccgagttcggtaattcctaatctaaccctgtaggtagctttggaacttgacaaatgcagccaaacgattgatttcgaatgactgaaccctcattggacagaaccatagatatatacaaatactaagcaacaggatcctttcaaaaagtcaactttattctttgtttcttctgattataaaataataatacatgcttgatgataaaaactcacaacataaatatgtatttacacagaaaagtgaaagattccagtaaccctacacctacctcatttttaaaatctcctacaaaatattccgtgttacatatggaccatagtttatttacatgatcccttatatctctttgttgttgttgttgttgttgtttttgaaacaaggtctcactctgtcacccaggctggagtgcagtggtatgatcatggctcactgcagcctcaagttctaggctcaagccatcctccaacctcagcctcccagagtaactaggaccacaggcacacaccacacccaactaatttttgtatttttcgcagacagaggattttgccttgttgtccaggctggtctcaaactcctgacctcaggtgatccgcccacctctgcctcccaaagtgctgggattacgggcgtgagccaccatgccctggcaacctgttacattttttgcagagtaattctcaggctctgtcagcattgctttcctaagtcgttctctgcccaaatccctctgcctactttctttttatctaaatgtaacctgtcactggagcctcccagagacttagggaagctgtctgaactccagctccctagccttggatgtctggaagcctcactctcatttctgaatcttgcttcctcttgagtctgcttctcttagtgaatccaggcagccttctcatgcccatcactcaccaaacctagacatgaagcttcattctctctcctctaagagcagttcattgtgggcaaggatttcattgaatttttggtagcggagcatcagagggttgacactgggttcagcgaatccacccaccatttctccctctggctcccctgcctcccccaccctctgattcccaaggcaaaagcctgtcacaagaggttctcaggaaatttaatgcctcattccacagcccatcgggccagcctgtccttctcagccccatctcacaattctggtgaattagaagccctccatcttgtcatgcaaaaatactgcctctccattctggaagccccatagctccaagtctgcagctctgttttgccatctgttctgtggttagcttgcacgtggatcatgtgaggcctaaagctctactcctttgggcaggaagtagaacttccagattcactcattatttaaaagaatcccacagggtacagtggctcacacctgtaatcccagcacattgggaggaagaggcatgaggatagcttgagcccaagagttcaagaccagcctgagcaacatagcaagaccctgtctctacaaataaaaaaaacttagttgggcatggtgggacacacctgtggtcccagctactggagaggctgagcccagaggatcacttgagccagggacgttgaggctgcattaagctgtaattgcaccactatatttcagcctggacaacaaagtgagaccctgtctcaaaaaaaaaaaaaaaaaaagaattccccttggacagtaagacaagcatggtgccttctcctgtatagcccctattggcagtagtaattcaggatttgactgcttaatcattgcatgcccactgtcctgtgactcagcctcctctaaatttatgctctgcagccagttgcagtttttaccagcttcagaggaagggacatccacttagaagttagtatgataactttaagccacattgtgccagaaaataaactgagacacataacatgggagtgactctggactggtccaagacatcagaaaatctcttcattcaaacaccagtcagtaagatgaattatggagacattctcttgaatagtcttccttagcagcattttattaattttgctgtatgtggacagccatagcagttcattcatgtggtctgtttctaaacgttgtttcttggacaacatacgtacagaagctgttctcttctgacaccagccactctactgagagtagttcagacacctgcaccatccttgattatctcatttccttttttcaataatcttatgagataaggtattattatcttcacttaaaaatgaaacaactgaatttccaagaagatacattaccaaagtcacacagccagtaaatgctggagtcaggattcaaacatagctcagaatcactccaaaagccatgctctttgtcacaattggaccgtcattgacaatggaacattctgactcagttcctattcttgcattccaaggttcattgagaaccattttccaaactagcagtaatttctaaaacctagaaaaacaacataactaacttaaaaataagttctaaagttcatgaatgtttgcacttgagaaaccttatatttaattagtggaggtagaagacatagacttttgagaatgttttaaagggaagttgagagaattttcaagggtttagaggctaatggtatgggctctttagttttagtttagttttttatttttattgtggaaaaaaaaaacacctctaagaaaagtttataacgtgtatatatatggtgctggttaaaaatagaaaattacactacttggtgaccttccccagtcatacagcattagcactgtgctatgtctatatttgtgtactagggacacatttccctttccttgacattatcaggacaattttttactcattaacctttattagaatcattctagtgatttacggaagaacaaatagaaagggaaagggaaaaacattcctgtgatcacaggaaaagaaccagaagaaggagaaagagggggatgattaaagagaatagatggataggtttttataagaaaacttttttctgaggtggaatgaatggtgctagaaaggaaaaggaggcgtgggctttagaaaggagaaaggatgtactggggaagagatagagctactggcactgtgggttggaggtttggttgctctccggagcaagcgaggaggaagcaggcagaaggggcagcccaggcaagaggagggggcgcattttggagatggacactcaccagtttggttagtcatcatttgggagatatcccctagattgagcgtctgagagtgtgaatctctcgtgttctgttctaaatggaaagatcaatgcccaggaatcattgttgtttttaaccaacataaagtgttgtttaaatattgagtgcacctgtaatcccagcactttgggaggccgaggcgggtggatcactgaagctcaggagttcaagaccagcctggccaacatggtgaaaccctgtctctactaaaaatacaacaattagccgggtatggtggcgggcacatgtaatcccagctacggcaggctaaggcaggaaaatcacttgaacccgggaggcagaggtttcagtgagctgaggtcacaccacttcactccagcctgggtgacagagcgagacttttgtctcaagaaataaaagtaaataaatatggagtgggtgttgaagtgaacaggttaggaactgaaaggacaatagcaggaatctgagtagtagttcagaagaaaaaaaaaggaccacaagtcttttagtaggctggaaatgacaaaagagactcatcactaagctttatcattaaatgcctttgtttaatttatcactacagtttacatcacctttttttttttttttccaggagccttgcaaacaacaatctccagacactcccaaaagatattttcaaaggcctggattctttaacaaatgtgtaagaggacctaagaaatcactgaacaattaattaatttgcagtcattaacaaggaagcctggtattgattattataatttttaattggcttttaaattaaaattaggatttttaaatctaaattttaactggccaaaaatttaaatttacatggactaacatttgagtcttctatggtatttatcattgggaattctgaatacatggcacccaggcattcctttgacaaagtgtgtgtcaatacggcagggagcgatgataaaggactttgacggggtgggaagagacccggctagaaatttcaaaatcccttttttctcatgaggtccaggaaatagggctacaaaggaaaaacataaaggagtctgggaaactgacagaataaagatgaaaggttacatccttgggttggtcaatcaacagagaaatggaacaggaagtgggggaagggagaaaagtttgccttttttctcattagactgaacaacaactctaagcttaatccccaggaatttggcttaagccccaggaagggaatgaacttaattatttttgaccctttttcaaacaaaagagctttcaaactttgacttttaagcctccgagtgaaagatctttgcaaggaatttgtatattttgctgtaagcaaagcaagtaatatatgcctaaacttctcaaaagcaattcagcttcattatttgccttccagaacattagaaaggtatttaaatgtcataaggtggaagacaggaacaaatgaaaggatatatgaaaacaaaagcttttttaaaaaattattcaggtacttgtctgtagaatatatattcaaaacaacttttctccaataacaaacaaaaagaaaatctgagtcaagtactttcttccaagcccagtatttaacttcaaatcagtagcctaatgaaaaactttctttgttccttgcagtatttccccagcccctcctccatgtctattacctcaattcctgaatgatatggtttaattccaggagaatgcccaaatcaggattcttccaagagagtcctggacagaccatagttatcctctctggtttacagtagcctgaaaggttgccactcattagtgtgggtcagagttctcttgggagactaggtcagttctgggagtgtcttggaagttagaacacactccatgggtgacgtgggatgtagctcattgggggtcctttaccccatttttgtgtcagtctataccctacactagtgaaagacaaaacaaaaaaatattgaaattggctcagtctctcatgggaatcccaagatgggtttagccttttggacctactctaatatgcccaaatcaagaattatcttagaagtacaaggatccatgccaacttgccttttagtggatttcttggctttcttgaaagtatcctctaaaaaacatttttaaatgtttgggcgtttaaaaattatttatgtgtggtgtgaagagtaggcagcacctatcttaagaattctgtgtgaccaggaaaggaggtggaattcctgaacagaagcaatgcaaatacacagagaacttggtgagttggggtcatatgtggatatgtaaatggtctatgctgtataacttattacaggcatgagcgattgtatgcctgtgttaactctgctgtgtcaaagtcatttcctatttaaactgaatttgtagaccacggaagaggatcaggattaattatgtctgtgaggaagaagaaaagcaaatagctcacttgattaaatacattacaataatcactacattctgtcctttagacctgtgctgtccaatagggtagccaccagaccttatggtcactgagcacctaaaatgtgctcctagtacaactgagagactgaattttaaattttacttaattttttaacagttaaatttaaatttaaaagctgattctcagctcaattattggaaaatgttaagtacgcttggaataatttgggtatatacacctatttttttcaattatgaattttatgacatctaaatatagatcacctatttctggtaaaatttagcatctgaattgagatatattgtaggtataaaatacacactggacttcaaagacttagtataaaaaaggaatgtaaaatatctcaataatgtttatattgatgatgtgtcaaaatgataatcttttgtatgtattgggttaaataaaacatattattaaaatgaattatacctgcttctttttacttttttaatgtggctatagaaaattttaaattacaattacggttcatatactgtttctattgacagcacagccctagactaagccgctttggaattcaagagggagtaagtgatgaggttccattgactgggtagtcttcaagtgtgcatggtgctaactctctgagcccaaagtgaatgagtggtcagtcaggttccaggcaggttatagggcaggatgcaacgccgggtaaggtcattctgcacatgttaattgttgatgtagaactctttcctgcgtgggtagggcccttgtacagcaaaagcagctgaagtttgtctttcagggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacaggtaatgtactcatcatcattccacctcaaaaaattaaaataagggctacctttttttttcatgtgcaggaactgatattttttatatcttaaaaactagctgagcaacttaattttaaaaaaattatgaaccattgacaatgcttcatgtgtttaaaagtaaaatggccattttactattctctgaaataaatgtatttcttgtgaatatttaagatctagccaaggaaagaggtattagctcacagttacttattatttcctatttttgcagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggtatgaaaagcctaatgatattttgagtggtaatttaaactgcttcagccaagggcaacaaggaaagatgagtggtataggggaatgctttagcatttgaattccaactctaccatttgttaagtgacctgggattgttctctaagccataatttccccacttgtaaaacgggaataatattaatacttaactcacaaggttgttaataagatcatgtgaacacatattcaagaaacttagcatagggtctagtataatacataaacagtaaatatttgattatttttcttcaaataaaagtattggatggtgaatcatgagttctagtccaggttctgccacagtctatttgggcaagctgctcatactcactgacacccctcaacccctttttcttaactataaaataagaaggttattttagatcaataagtctcaaatttgttacacaaacgtgtcttctacaaaatgttaatgtatgccttgtaatgaaaaggattttgtggtccaataaattcatgaaccatatcttggtcttgtaggttcataatacagacatctgtggatctgagaagtcctgcagtgaggaaatttttccaatatttttcacccttaatttggccatggaatttaattctttcttttcttttcttttttctttttttttctttttttttttttttttgagacagagtctcgctctgtcacccaggctggagtgcagtggcacaatctcagctcactgcaacctccaactcccgggttcaagcaattcttctgcctcagcctcccaagcagctgggactacaggtgcgtgccaccatgtccagctaatttttgtatttttagtacagacagggtttcaccatattggcaaagctggtattgaactcctgacctcatgatccgcccaccttggcctctcaaagtgctgccattacaagcgtgagccaccgcacccggccggaatctaattctttctatgaaaacttttacttatctggatctctctttttttttttttttttttgagatggagtcttgctctgttacccaggctggagtgcagtggcgtgatctggggtcaatgcaacctcagcctcctgggttcaagcgattcttgtccttcagcctcccaagtagctgggactacaggcatgtgccaccacgccctaataattttttgtatttttagtagagatggggtttcaccaagttggtcaggctggtttcgaattcctggcctcaagtgatccacccgccttggcctcccaaagttctgggattacaagagtaaaccaccttgcctgggcttacttagctgatctcttaagtttctttcccattttaataatttttaaaattataagtcataagttagaacatagggctccctctacaatttttaatatcagttttagcttctaatacctttaaatctgctctcaagagcactcacacctccccataaaaggtaaccctttagacaaggcatggagggtcatgatagattttgctggtagccatcaccctcattgctcaaaggaccaagacaggtctggggcttgcttgaggctggggttgcttaaataaagggatcccttccaaactgagacccttttggaatcctcctttcttttagaatcctcctctctgaaggaagaaggtcatgcttccttaggcccccataagttttccagtggactatagcagggttttgtgcggtcgaaaccaggcttttcttacttgtgtatggttcatcaatttctttgaatgactctttagatgagcacttacaagagaaataaatcatacatctgcaaactttctgagggcatctcagagctcatcttgtctaggatgatgtcttagtcccttcctgctgctgtaacaaaaaataccttgactgcgtaatttataagaacagaaatttatttctcatagttctggaggctgggaactccatgatcaaggcaccaggagatttagggtctggtgagggctcactctctgcttcaaagacggtgccttctctgtgtcctaacatggcagaagggcaaaaaaagatctaacagactcgctcaagcccttttgcaagggcacaaattccattcatgagtgtggagtcctcatgatctaatcacctcctagacaccccacttcttaatactattacactggggattaagctacaacataaattttggagggacagaaacattccaaccatagcagatgacaaatatatgccccatactcagtcattatcccttccttcactctagacaggcaccactaatctatcatgggaatctttcatgtagagtgcagacacggccacagaatccttctcaacacagttccccagacaatcacacgcaatgagccaatcagtattggtacatgtgttggaatctggtggccatccttaatctagtctaaagtctcattgtacagaaaagaaaactgagcctcagagaagttaaatgattttcttaagatcatacaatcagtttagccctgaaaagagtcagaaataaaactattttgcctatggatgaagccaattagtagaaagaattaatgtagaactttctgccccgcactagcgctgtagtcagaagaggcctaaagcccagatttgttcagctgtctctggattttctagagccaaactcctgcaagatcagaatctactgataaatgtcaaactcttccccaaaggataccaagctaggccactgacagatcccacatcattttctgtgattttccaaaataactttcaggagcagtgcccatggctgcacccttctttcgatttttttaaagattccttttccttctcttcactcctgccaccagtgacctaaagctccagaaaagtgacaagtggcatctcctttctttgcaggggaaaggcaaattattctagagcaggaagcagttcagacttagagcaaaacaattacagtagagccatgggctacccagaccacaacgctagcctttggttatctaagatcttagataaaccaaatttgaagtcctggaatagctaacttgtccccagcttgggttaaaagcatagagatgctggtaggcctggctttgaatccccaactctgccttctgctaccagaacagcctctctgagcttcagtttactcatgtggaaaaaggataatatttatctcttaagattgttgggaaaattaatgaggtaaattgagaaagcacataatagatgctcagtaaacagtagttttcattagaattatgattaactcatttgtgtcagggaaactaatgctttctttctgcaagaagtaagaggagaacactcgggccatagctgtgtgtcctgaacgtctagcgcaggctagatatgacattaacaactcaattgttggcaacaaggccccacgaggcacaaaggcacggaactttaggacactgctgccattgggctttggagaccagccttgcctaatcaaccaaggagatctcttgtttcaggctgatttgggtggaagttgtatggccccagcccgcatgtttacatgctccaaaagaggatggccacacaactaatctctcctttgtcttttcccaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcata

SEQ ID NO: 465 - DNA, 28173 bp, Homo sapiens
gttaagtggcttagatgaaatgtcttttttttttttggttatcagataaccctttgtgaaaatattttcctttgcattctttaactagctgggcattccacagcttcactgttggtatcatctgtgatactatcaacatggcagctcacagactgggcaggccccaggaattctttttttttttttttttttttggagacggagtcttgctctgttgcccaggctggagtgcagtggcgcatattcggctcactgcaagctctgcctccagggttcacagcattctcctgcctcagcctcctgagtagctgggactacaggcgcccaccaccatgcctggctaatttttttgtatttttagtaagagacggggtttcaccacgttagccaggatggtctcgatctcctgacctcatgatcctcccgcctcggcctcccaaagtgctgggattacaggcatgagccaccgcaaccggcccccaggaattctttaatggttccagagagttctctggctaaagactgctgctgcatctgttaggcaatgttgacaatctcatcagaagtggtgctaccactgtgtttcatgtttttgtgtttctttctttctgtcggtggttcctgagggttgtgacgatcagggcagaggcagaaggcaccacctcaatctgggcctgtctgctgtggctggtcagtttcactatcatcctcagactcttccagtcaatggttggtgatgtcatcagcaaccatttttggagacagacccagggagctgaccttgggggccagtgcagatgtggcactgacttcaccactggtacacctcagatatacaactttgatctcgctggggtcaaacgtaggtggctgcggttggttgaactcaggttcaggatgactgaagcaagttgcacttggctttctctgagccgaaaaacgaaaggtgctcaggctcccagcaactctgtgaagaaagagttattatcatctcagtttacagatgaaacagaagctcagagagggcaagcagctagcacaaggtcccacagctggactcagggctgctggctacagggcctggctctacatgctgcacagtcagagagggagagtcccatgcgcagttggaagggagaagggaaggggaggctggcgctagatagtaacaagctgtgtgttttgggcatttcccctgtaccagacactgtgctaaatgacccttctgctctgtttgcctggaaaagtccccatcttagtgaattctgactttccacctactgtcccggagcagctgactgtggtggagaaaactgcaggacagggaccctcagctgctgctatacagccagtgatcctgccacgtccctgactccatgggctttcaacacgaggcctccccaacgcagtgtccacaccagcattactgtggaacttgggagacatgcagatcccacaggagagggaagggggagctgctctcaattcagatcaagtttcccctgtgccagaagaatcagtcctccagatgggtgggcagcactgggcctgaggtgaatgttactgtgctgtacgctcacaaagttagagggcagagctcatattaaaggttcatactgagaggtgaagccagctggacttcctgggtcaaatggggacttggagaacttttctgtgtagctaaaggattgtaaatgcaccaatcagcactctgtaaaaatgtaccaatcagcgctctgtgtctagctaaaggattgtaaacataccaatcagcacgctgtaaagtggaccaatcagcactctgtaaaatggaccaatcagcaggacgtgggcggggacaaataagagaataaaagctggccaccccctgccagcagcagcaacccacttgggtccccttccacactgtggaagctttgttcttttgttcttcataataaatcttgctgctgctcattctttgggtccacaccaactttaagagccataacactcaccgtgagggtctgcggcttcattcctgaagtcagcaagaccacaaacccactgggaagaacaaacaactctggatgcaccatctttaagactgtaacactcactgcgaggtccacggcttcattgttgaagtcagtgagaccaagaacgcaccagaaggaataaagtccggatacattttggcgacccagatgggaaacactcaggcatcaacaggctcacccttgaaatgcatctaagccattgggaccagtttgacccacaaaccctgaaaaagaggtggctcatttttttctgcactacagcctggccccaatattctctctctgatggggaaaaatggccacctgagggaagtataaattacaatactatcctgcagcttgaccttttctgtaagggagaaggcaaatggagtgaaataccttatgtccaagctttcttttaaggagaatccacaactatgcaaagcttacaacttacatcccacaggaggacttctcagcttacccccagatcctagcctccctatagccccttcctattaatgataagcctcctctaacctcccctgcccagaaggaaacaagcaaagaaatctccaagggaccacaacctcccccccacccctgctatcggttatgtccttttcaagctgtatggggaggggaatttggcccaacccgggtacatgtccccttctccttctctgatttaaagcagatcaaggtagacctgggtaagttttcagatatatcctgataggtatatagatgtcccacagggtccagggcaaaccttcaatctcacctggagagatgtcatgctattgctagatcacaccctggcctttaatgaaaagaatgcggctttagctgcagcccgagagtttggagatacctggaatcttagtcaagtaaatgacagaatgacagccgaagaaagggacaaattccctactggtcagcaagccgtccccattatggatctccagtgggacctcaactcagaccatgggtactggagttgtaaacatctgctgatctgtgttctagaaggacaaaggagaattaggaaaaagcctgtgaattatttgatgatgtccaccataactcagggaaaggaagaaaatccttctgccttcctcgagcggctacgggaggccttaagaaaatatactcccctgtcgcccgactcactcgagggtcaattgatcctaaaaggtaagtttattatccaatcagccacagatatcaggagagagctccaaaagcgagccctgggccctgaacaaaatctggaggcattattaaacctggcaacctctgtgttctatgataaggaccaagaggaacaggctgaaaaggaaacgttagatcagagaaaggctgcagccttagtcatggccctcagacaaaccaaccttggtggttcagagagcacagaaaatggagcaggccaatcacctggtagggcttgttaccagtgtggtttgcaaggacaccttaaaaaagactgtccaacaagaaacaagctgccccctcgcccatgtccactatgccgaggcaatcactggaaggtgcactgccccagaggacaaaggttctctgggccagaagcccccaaccagatgatccaacaacaggaccgagggtgcccagggcaagcgccagctcatgtcatcaccctcactgagccccaggtatgtttaactattgagggccaggaaatcgacttcctcctggacagtggcatggctttctcagtgttaatctcctgtcccagacagctgtccttgaggtctgttaccatctgaggctcagtgttaatctcctgtcccagacagctgtcctcaaggtctgttaccatccaaggaatcctgggacagcctataaccaggtatttctcccacctcctcagttgtaattcggatgctttgctcttttcacatgactttcttgttatgcctgaaagttccacacccttattagggagggacatattagccaaagctggagctattatctacatgaatatggggaacgagttactgatttgttgtcccctgcttgaggagggaatcaaccctgaagtctgggcattggaaggaacaaactcaagctccagccttaagccttcccacaggacaaaacttctctttatacatcacagagagagcagaaatagctcttggggtccttactcagactcatgggacaaccccacaaccagtggcatacctaagtaaggaaactgatatagtagcaaaaggctggcctcactgtttatgggtagttgcagcggtggccgtctcagtgttagaggctatcaaaataatacaaggaaaggatctcactgtctggactactcatgatgtaaatggcataataggtgccaaaggaagttatggctatcagacaaccgcctacctagataccaggcactactccttgagggaccagtgcttcaaatacatacgtgtgcggccctcaaccctgccacttttctcccagaggatggggaaccgatcgagcatgactgccaacaagttatagtccagacttatgctgcccgagatgaattcttagaagtccccttagttaatcctgaccttaatctatatactgatgaaagttcatttgtggtggagaattggatacgaagggcaggttatgccattgttagtgatgtaacagtacttgaaagtaagtctcttccccagggaccagtgcccagttagcagaactagtggcacttacccgagccttagaactgggaaaggaaaggagaataaatgtgtatacagatagcaagtatgcttatctaatcctacatgcccatgctgcaatatggaaagaaagggggttcctaacctctggggaaccacattaaatatcacaaggaaatcatggagttattgcacgcagtgcaaaaacccaaggaggtggcagtcttacaccgccgaagccatcaaaaaggggaaggagaggggagaacagcagcgtaagtggctggcagaggcagggaaagaccagcagaaaggaaggagagaaagagacagacagagagaaagagaggaagagacagagacaaaggagtcaaagagggagacagagagaggaagagacagagaggctgaaagtcaaagagagaaggagagagaggaagagacagacaaagaagagtcagagagagagaaacagaaagtcaaagaaagagagggagagacaaagagggagtcagaaggagagagaaagacaaagaagaagtcaaagagaaagaaagagagatggaaatagtaaagaaaaaacagtgtaccctattcctttaaaagccagggtaaatttaaaacctataattgataattgaaggtcttctctgttaccctataacactccaataccaccttgttatcagtgtaagcaagggcgtagcctgaaagtactgaggccactgacaacccatagccttcctatcaaaaatccttaacccagcaggtttcctaacaggggatctaactcttaactaattaccatacaaaggtccaaccagacctaggaggaactccttcaggacaggaccatagatggttcctccccggagattaaggaaaaaagacacaatgggtattcagtaagtgataaggaaactcttgaagaaacagagttaggaaaattgcctaataattggtctgctcaaacctgcgagctattggcactcagccaaactttaaagtacttacagaatcaggaagaagccatctataccatttctaagataatatggactgaacgaggttttattaatagcaaagaaaaattaaaatcccaaacttataaggttttcaacaaaagtaaagtttgctaaaatttaacagtgtaacatgtattatcctaacctctaatcttatggaaatcagaccctatcagcgcccctcaaagctcaagtccatcagtgcagagccatccactaatacccctacttatagggttaggaatggccactgctacaggaaccggaatagccagtttatctacttcattatcctactaccacacactctcaaaggatttctcagacagcttgcaagaaataacaaaatctatccagtaaggatagtaactacgatcccaaatagactctttggcagcagcgactctccaaaactgccgaggcttggacctcctcactgctgagaaaggaggactttgcaccttcttaggggaagagtgttgcttttacactaaccaggcagggatagtacgagatgccgcctggcgtttacaggaaaaggcttctgaaatcagacaacgcctttcaaactcttataccaacctctggagttgggtgacatgacttctcccctttctaggtcccgtgacatccatcttgctattactcacctttgggccctgtatttttaacctctttgtcaaatttgtttcctctaggatcgaggccatcaagctacagatggtcttacaaatggaaccccaaatgagctcaactaacttctactgaggacccctggaccaaactgctggccctttgactggcctaaagagttcccctctagaggacactacaactgcagggacccttctttgcccctatccagcaggaagtagctagaatggtcatcacccaattcccagtagcagttggggtgttccgtttagagggtgggttgagaggtgaagccagctggatttcctggatcaagtggggacttggagaacttttctgtctagctaaaggactgtaaatgcaccaatcagcactctataaaaatgcaccaatcagcgctctgtgtctagctaaaggattgtaaacacaccaatcagcactctgtaaaatggaccaatcagcaggatgtgggtggggacaagtaagggaataaaagctggccacccccagccagcagcggcaacccactcgggtccccttccacgctgtggaagctttgttcttttgctcttcataacaaatcttgctgctactcactctttgggcccacgccacccttaagagctgtaacattcactgcgagggtctgcggcttcattccttaagtcagcaagaccacgaacccaccaggaggaacaaacaactctgaatgtaccatctttaagatcataacactcaccgcaaggtctgtggcttcattcttgaagtcagcaagaccaagaacccaccagaaggaataaattctggacacaataccacaaaaagacaaagaaagcaaaggtgcgggaagaaacttttggacaagtttgtccaacctgtggcccaggtggctttgaatgtggcccaacacaaatttgtaaattttcttaaaacattgagatgttttgcgatttttttttttaaagctcatcagctatctttagtgatagtgtagtttatgtgtggcccaagacaatcattcttcttccaatgtggcccaagggagacaaaagattagataccctgcttttggaggcgagggatgtgtttattgccttggccgtggtgatagtttcctgggagcacaaatatgtctgaattaatcaaactgtatatatcaaggatgtgcagctttgtgtaccaattatacctcagtaaaaccattacaaaaaggaaaagaacaaaggaaatgcaaattcctagagtccaccctggacctacaggcccagctctctggggctgcccagccacctgtgtccagcaaggtgggggcctgagaagcactgcccaggcctttgctcccctaatggactatttcacccttccctaactcgtcagacctcccataccacatcctcactctcagctgatcacctgctttcctatttcactgagaagtcgaagcacctagaagacagcttggtgtttcccagcaccaagggccccagctcctgctcagcacccttctgctcagctttccctcttgaggctggggaggaaccggcagggtgaacgcgagtatttctcctcatgcacaagaagctactcaatgcagcagctatggccgcccctgggaactagctggaagcagctgggggttgctggggggaggggtgggtgggtgggaatctgcatctttaatagtttctaatttcaacttttattttaaatacagggggtacatgtgcaggtttgttacctgggtatatcgcgtgatgctgaggtctgcagtaaggatcgcatcacttagcatggtatccagtaggtagtttttttgactggcccccgcacccctggactctctccctctgagaatctgcatttttctttttttcaggatccctaggtttgaaggaatctgcattttaacaagactctagttgcttcgtacagacattagactcattcctcctcctcactttctgttggaccattctctcagcaatctgtaaactgtaatctgctccattaaaaaaaccaaaacatcgatccacatccctctccactgcttcatttgcaagctccaggttctgccttcccattctctctcaaacctgctctgatctttgtccagctcctcaccgaccccttcacggaggcccccagtgcacctgcgcagtgaggtcagcttcgcaggggcccccagtgcacccgcacagtgaggtcagcgttggctcttggcctctcttccctgcgactctgcccgggcaccagccagtcctcattccctccctactgctttttttttttttttttgaaacagggttttgctctgtcacccaggctggaatacaaaagtgcaatcatagctcactgcagccttgacctcctgggctcaaggaattctcccacctcagcttccttggtagctgggactacaggcacaccacgcccagctaattttttgtattttttgtagaggcagggtctcaccatgttgtccaggctggtctcaagccatctgcccgccttggcctcccaaagtgttgggattacaggcgtgagccacgtgcctggccattgctatttttaaaatgttgtttcaattacccccagggtgtcactccccttcaggatgctttgggccttccagagtaggaagagtaacaagagacctggttcacctgtggtgaagccaggagaggtgtcatgttggttgaaatgcctgcagaaccctcctgttgctgtgctcaggccagaagctgcacagagcatgggccgataaatgcatccactccccgtgctttcccaggagcgcccaggcctgtcctcagtatcaagtcaatcacattttcagcatggtaggaggaggcaggttctgcaaatgctgcagggtgggttaatcacacaggccaatcaagtccctgtcgtcaccacgattggcagaggccagccctcactcccatcttgtttccttctcagtaaaaatcatgtcacgcagccaggcttggtggttcacgcctgtaatcccagcactttgggaggccaaggtgggcggatcacctgaggttgggagttcgagaccagcctgaccaacatggagaaaccctgtctctactaaaaatagaaaaattagccaggtgtggaggcgcacgcctgtaatcccagctactcaggaggctgaggcaggagaatcgcttgaacccgggaggcagaggttgctgtgagccgagattgagccattgcactctagcctgggcgacagagctagactccaactcaaataaataaataaataaataaataaataaataaataaatatcacaccacatcactctttccaactgaaagagtgtaatttaaaaaagtgtaaaaactgccaaatgtaagtccacattattatccattcttgtaggaaacgtaataaatgtgctccacaaatcccccaccctcctagatactggcattgaatgaggcgcccacgtgggctctgccctgaacttttcttccttcttgcccttcttctttccttcatgcctctgagaaggaaactctccttctgcatctggagctgagctccccaagggcttctaagcctacttcccacaccttccgaagagccttatcccacagagccctcactccctcaccgctggcttcctccctctgtgggctcctttcccagtctgtaaacatgccacatgctcatcccctcactcaccctctcggagaaaactactgtcctgtcaaactgctttcttctttcctttccttcaccacacaatgcagccaagggtgcagagagttgctcaggcccctgtgcagcccatatctcccacccactcgcatggcccaacctccagtgatcaaatccaacagccgtttctgtccccaacctgccgcccttgcctccagttgaatttgacagagattactctgtctacatcttaaaaaaacggaaaccaatgaaagaggcaacacacaagactcaatatggacagtaatacgatggagcataagacggccatgaaacacgacattcacaaagttttaaagagcattaggatttgcttgtaaaataaagttagagggccaagtgtggtggctcacacctgtaaacctagcactttgggaggctgaggcgggcgcatcactcgaggtcaggagtttgagaccagcctggccaacatggtgaaaccctgtctctactaaaaatacaaaaattagccaggcatggtggagggcgcctgtaatcccagctactcaggaggctgaggtatgagaattgcttgaacccaggaggtgcaggctgcagtgagccgagattacgccactataccccggcctgggtgacacagcaagactgtctccaaaataaataaataaacaaagttaagggaaaaactgcacgtgcagcatcagctcaaccgtatgcattttatttattttttatgtaggtattttttttgagatggaatctcactctgttgcccaggctggagtgcagtggcgcgatctcagctcactgcaagctccacctcctggattcacgccatactcctgcctcagcctctcgagtagctaggactacaggcgcccgccaccacacccggctaattttttgtatttttagtagagacgggatttcaccgtgttagccaagatggtcttaatttcctgacctcgtgatctgccccccttggcctcccaaagtgctggcattacaggcgtgagccaccgcgcccggccctgcattttattttttatttcttgagagggagtctcactctgtcacccaggctggagtgcagtggtgtgatctcggctcactgcagcctctgcctcctgggttcaagcgattctatgcctcagccttccaagcagctgggactacaggtgtgccccaccacacctggctaatctttttttttttttttttctgagacagagtcttgctctgtcgcccaggctggagtgcagtgacatgatctcagctcactgcaacctccgcctcccgggtttaagcaattctcctgcctcagcctcccaagcagctggaactacagtcgcatgccaccatgcccagctaacttttttgtatttttagtacagacagggtttcactgtgttagccaggatggtctcgatctccagacatcatgatccgcccgcctcggcctcccaaagtgctgggataacaggcatgagccaccgtccccagcacgcctggacaatttttgtatgtttagcagagatggggtttcaccatattagccaggctagtcttgaactcctgacctcaagtgatctgcccgcctcggcctcccaaagtgctgggattataggtaggggccaccgtgctcagccctatatgcatttttaaagactaagggaaaataagagtggttccatctgggtggtggaactatagattatttttgttttctcctttactatcttctgtattttacaataggccttacaaacaaaagtctgggagattaaaagggacatttttctggtctgccacctgctggtggattctagcaacgtcctgggttaaattaaattcagtgcttgctcctccctcttctcactgtctgagcaccctccctatagttccctccagcttctttagcctgacttttgccatctcgtttccattttgtgatcctttccctcttgtcttgtgtattttctcgtgtaagtttttttggtaatatatgttaggtcctcgctattttcaggtcattacaatttttacctctttgcatctcttttcagcgacttctgctttttttttttgagacggcgtctcgctctgttgccaggctggagtgcagtggtgatcttggttcactgcaacctccaactcccgggttccagtgattctcctgcctcagcctcccaagtagctgggattacaggcgggtgccaccacgcctggctaatttttgtatttttagtaaagacgggatttcaccatgttggccaggatggtctcgatctcctgaccttgtgatctgcctgcctcagcctcccataatactgggactacaggtgtaagccatcgtgcctgggcgagacttctgctttgattgagcttagtaacacacactcaccatgggagcgggtgtgcttttaggacaagctgacagccctggtggaagtgggtgttagttaaggcaatcagaaatcctggcaagtgtagtacgtgctctgggaggcaggttaagccacaattggcaatcaatgcccttggtcacattagtgagaacgccctggcagccatgtggagggtggatttgaggacttggagaggtgtatttaagacatggctgccactctctaggaggagagtgagagagcttgggcaggagtcgcagtagggatggtgtggaacaggcagattagagagccgcccagcagctgtcctctgcagggactccttaagagggaggagtcatgactgacccccagctttccaacacaggttgggtgagctgtgatgccaccaaccaaggcaggaatgcaggcctgtatgtcagtgggttgtggggaaggctgggttttgaataaactgaatgtgagatggcctcagaacatccatgcagaaacgtaagcaggcagtggaaagtaagggctagagagagatctgagtgttactgacattagggtgtagctgaaacccgaggcatggacgacaacgcttcaggagaaaatccagaatgacggagatgctggagacagaagctggtacgcatgagcacggagggccagcctgacagaggagtgcagaggcagagaaggaaaaggcagaaagaaaaacccaggagtgcattattgcatgtggcaacagtccagaaggggtagtgatcagtaagtgaactgaaagggtcagtaatctaagggctaaaagtacatcacttgaaatggcaagcaggacgtcactggtatctgaaaggaagagtctgcacagagcagcaacaacgacgccagactgcggggggtgggaggtgcctatgagctgagggtatcaagtagagactcttcatgaaagtgtgtatgggaaaagatgctccagagggaataataatgagaaggggctgcagggtgcaagagtcagaggacaaaatgagacaatctaggtaagggcttagcacactatctcgcatttactaagtgctcaatgcacataaagggcttttatcgcccattcattaactatataataattttaaatttaaatgacaaaaatcagtccaaggagcctgcataccagtcggggagaaaaacaatcaacaaaataaataaattatatggtacatttgctaatagcaaatgctaagaagaaaaaataaactggggaaagaagatatcaaatgttgaagaaaaggacacaattttagatagggtggcctgggcaggcctcgctgagaaggtggcttgtaggtaaagacccaaaggaggtgagtaaagtaactataattagggagtaatagaaaaatattagttatcattgccagagcattcttcatatattattgttatggaaacatctggttattattctattattgctactctctttgctgcaattaatgttctttttttttttttttttgagacagagtctcattctgtcacccaggctggagtgcagtagtgcaatctcggctcactgcaacctctgcctcccagattcaagcgattctcctgccttagcctctcaagtaactgggattacaggcgcctgccaccatgccaggctaatttttttgttttgttttgttttgagatggagtcttgctctgtcacccaggctggagtacagtggcacgatctcggctcactgcaacctccgcctccggagttaaagcgattctcctgcctcagcctcccaagtagctgggattacaggcgcatgccaccacgccgggctaattgttgtatttttagaagaaactgggtttcaccatgttggccaggcaggtcttgaactcctgacctcaggtgatccacccacctcagcctcccaaagtgttgggattacaggcatgagccaccgcgcccagcccacgattaatgttcttataatcactgccatctctgggtgtttagtagtttcagcagtggcatccagtaaccacggtttctattacaaaggtgcgtggaatctaggaaaaccggggacaacagtgtaacatgctgtgtcatcatcatcagctggtttgtaagggcagaagcaaagccaagtggaagctgatcgtgcacgcagctgctgcaaacacaaagctgctcatgtgtgtgctgaggggaaagagggcagtcccagactgatctttcagtcccacctgtacacgtgaaatagccgcacaacaggaccatcttcagacctagagggcattgacgcaggcatctctggaggaacagaaaagtggtaactacatctcaaatcagtgcagatggagagtgtgtaatttagaggtcacaagacaggagtgtttctaccagaacactgatttggtggttagaaacaggaatccgctgatgccatctgggaataattaagacgaacgggaaattcttgctctgtgccaaaccgagcccaacgctgagagtaaggtgggtgtgtaataagcacttactggatcacactgaataagaggattcaatgttgcttgtgactgatgcatacaatgattaaaaagcctgatctagactaataattattctttgcaattcagagagaaggatcaaaaaaggaaaagaaagaaaaggaaaaaaaagtagaaaaagaatctaaatgcctgaggactcatcctatctttactccgtttaagaggctataatattttttaaagctaaatgtcaagtgtttcattccttaagtcacaggcttccgtgggtggatgggacaggccagaaaaatgggttttaaagacaaaaccccattcttaaactcaggttaacagaagttttgtaaatatcttagttacattttctttttttctttttttttttgagacggagtcatgctctgtcgcccaggctggagtgcagtggcgctatctcagctcactgcaacctctgcctcctgggttcaggcaattctcgggcctcagcctcactggtagctgggactacaggcatgcaccagcacagctggctaatttttgtatttttagtagagatgaggttttatcatgttggccaggctggtcttgaactcccggcctcaagtgatctgtctgcctcagcctcccaaagtgctgggattacaggcacgggccaccatgcccggtccttagttacattttttacatgtatttattacttgaagggggtcaatactgaatttatctattaaaacaaacaaaaaccctcaagattaaaacttgatagcttaactagcagtgcttagaatatataaaagtttttattaatttcttgtaaatgcctgtgtaaacagattataagtatgtccttcttggctacgaaaccaaaagtgaaccattgtaatggccaagtaaaagcttatgaaggaagaaattaaatgggccaactgcattttatagctcaagctaatagcaacgtatgtgatatttttgttattattatcacagccttaccatgcagcagttactataagatatttcatatgtttgtgaaagtgtgtatgctatattatattcatgcatggtacatgcttctctaaggatcccacagcctgatcgcgcaaacgttatctattctactttaagagtacaaagagtgaaatatggactacgggaagattatgactgtgcttgggactccataatgtgcctgtcatggagctgggaactcagccccctgatcactgggaactcctcagcaggagtggaacatgcaggatgagggaagggaggaagtggaggagatggaaaactggcttccaactggtttcgctgaatctgtgactgacttaagaagcaggatatgaattaccatgcactttattgcctcctcttggaaacatccttatgtcattgcgctatggccagagccctgaaggacatctgctctccttgggagctgctgagccagggtgcccgtgatgtcttcagaatccttcagtcccgactgcaggagaaacttggcacaggccaagtgctgacctgcacaggccagatgcagggctgaggggtgacaaaaatcacatggacttaaaacacaatccctggagcaatactgacctcatgagttgatagtgcccaataaaaatatcaattctttcaatatcttccgtaatccatcttcacaacttcacctatactagatcaaaatatttttgtttctaacctgattgggttgaaaatagttttaaagataacaaaaccagttagagaggatttaagaaatttatctaggctgggcgtggtggctcatgcctgtaatcccagcactctgggaggctgaggtaggcagatcatgaggtcaagagtgtgagactagcctgaccaacatggtgaaaccccatctctaataaaaattaaaaaattagccgggcgtggtggtgcatgcctgtaatcccagctactcgggaggctgaggcaggaaaatcgcttgaacccaggaggtggcggttgcagtgagcactgcacgccagcctgggtgacagagcaagactctgcctcaaaaaaaaaaaaaaaagaaaaagaaacttatctaaagcaagaagcaacagagcaagttaacaagatataggatacatcctcttcatacgcctgaatgctctggaaacacactttaaatggtacaaaaaactttctaaaaggcttattgaatttgctttgtaagtaaaaatatcaccacaaataatcacgtagccaaaaaaacacttttgaacaagcttcccactctgggtgcagaaatcagcactgaggttcctggtgtgctgagttcaggggcactggtgattctgctgctttccctccagcagagaagctgtgtcccttcctgggcagagcagctgccctttccagccctagagtgagtagttaggtacctgcgagtctttgaagcatcagaaagatcccactaggccaggcgcggtggctcatgcctgtaatccctgcactttgggagggcgaggtgggcagatcacttgaggtcaggagtttgagaccagtctggccaacatggtgaaaccctgtctctactaaaaatacaaaaattagctgggcatggtggtgggcacccgtagtcccagctacttgggaggcagaagaatcgcttgaacccaggaggtggaggttgcagtgagccaagatcgtgccactgccctccagactgggtgacagagcgagactttgtctccaaaaaaaaaaaaaaattccactaaacccttgcaagatggcctttggctcacagaatgttagagggtttattttaaagtccaagtctaaagaatttgctctcagcagatgtttctgaatattctaaataaaaaaaatcataatgaatatagtttctaaatatactccaaaatggatgacctgtgaagaattgatacgatacctggctagcaggtgtcatcatggattagaaagaaactgcttttatgatgcatatattgttatggtttaaaataacaacaaagattaacaacagcagttgtaatgagtggcagtcatcatcactgttataataacaattatatgaaggctttgcagagaaaaagatattttaaggaaaagtagctgagctattagaagaataacattaaggctggtcacagtggctcatgcctgtaatcccagcactttgggaggccaaggcaggtagattgtttgaggtcaggagttcaagaccagcctggccaacatagggaaaccccatctgtactaaaaatacaaaaattagccaggcatggtggtgcatgcctgtaattccagctacttgggaggctgagacatgagaatcacttgagccaggaggtggatgttgcagagagctgagatggcgtgccactgcactccagcctgggcaacagagggaaactcttgtctcaacaccaccaccactaaaaaaaaaaaaaaaaaaaaaaaaaaaaaggaagaatattaaaatcattgttttaaatataaaagtgtattggttatactcagtttactaatttccaaggcatatataaaattaaacggtacctgatcgatttttttcatctttagaattgatgtcagctcccaaggataagagagtctgaattgtacttgtatgtccttcctgaattgaaacaaatttgttatcactgtgatgaggataaaagaaaaccttttgcaaaccaaaaagtatctgagacaggtctcaatcaatttagaagtttattttgccaaggttaaggacatacctgagagacaggtctgtgtctctctccaaagatgattttgagggcttcaatatttaaaggggaaaagagggctggagtgaagaggaggagggtatggtcacattactgaatccacattgcaggataaaaggagcaggggggggattaggcaatgatacattaaatatctctttccactcagtaaattggcactttacataagataaggtgaatataaagtagctacctgtggaaatatttaaccctttatctgtagctatctgcttaggaacaaaaggaaaggcagctttctgcatgactcagctttcagcttaattttttttcttttggcagagtgagttgggggtcttacgtttttattttcctttcacactttaaacacagactctaacatatattaggcaccttttctaaaacagtcgactgctaaaagtgaattttcatctttttttccctaatttattcttttttttttttttgtagagacaaggtctcactatgttgtccagactgatcacaaacttctgggctcaagggatcctcctgtctcagcctcccaaagtgttgggattacaggtgtgagccactgcgcccagccaaattttcatatctaaagtaagatattgtatcattctcaattctaatataaatcattaaataaatattttggtgacatttaattattagaatatagatgatcaactctgtgagccaaattactgacccaatgcagttagtttccatcattgtgagcagtacaaatcttgtgatttatacagaacccaaaactctaaaatttcccaagcaaatatactctttgttgaaatctttaggggagagataaactagaaaagatcataaccgctcataaatgggaattcctattacagctagtaggaattattataataaatattttataaaataaaaatattatttatatatatatatatatatatatatatatatatatatatatatttgagatgtagtctcactctgttgcttggctggggtgcagtggcatgatcttggctcactgcaacctccacctcccgggttcaagcgatccttctgcctcagcctcctgagtagctgggactagtggcatgtgtcaccacccccagctaatttttttgtattttttagtagagacagggtttcaccatgttggccaggatggtcttgattttttttttttttttttgacacagtctcactctgtcgtccaggctggagtgcggtggtgcgatctcggctcactgcaagctcctcctcccaggttcacaccattctcctgcctcagtctccctagtagctgggactacaggcacctgccaccatgcccggctaattttttgtatttttagtagagacggggtttcaccgtgttagccaggatggtctcgatctcctgacctcacgatccacctgcctcagcctcccaaagtgctgggattacaggcttgagccactgcgcctggccggtctcgatctcttgaccccgtgatccgcccgccttggcctcccaaagtgctgggattacaggagtgagccactgcgcctggcctataaaataatttatacactctttgtctagccagttagtctgctactatgtgatgagactacagttaaggttccaggttcactcttcctatgggagcaccctgcggccacagagcacatcatgtgtatctacccagctgctcgaaagcaggacatcaggcaggaaaatgtaattgatcagaaaaacaagtaggccgggcatggtggctcacgcctgtaatcccagcactttgggaggccgaggtgggtggatcacaaggtcaaaagttcgagaccaacctggccaacgtggtgaaaccccgtctctaccaagaatacaaaaattagccaggcatggtggcaggcacctgtaatccagcctgggcaaaaaagcaagactttatctcaaaacaaaaacaaaaacaaacaaacaaaccaaaaaaaaaaaacaaaaaataagtaaaagcataaagccaatagataatgttaaggataatatgcaaaacgctcctagcatttaaaacagctacttttccagtgaaaatgtttgcttatcttcaatataccccagagagcctagtaaatgcaattctcttgccctggctgaagagttcttaacttctgaaatccagtataagaacagagagccaggaatttcatacaatgggtatttatagcttcaaataacgttattcctgaaaacaaaaacctgtgtgtgagggggaggcactttatggagtaaaaggcttttttttaaagttttgtctagcaacaaattcaagtcaggtttctatttaaagagataaagcgcttcagaatcctgaccatttcagaagaatatcatgggcaatttcttccatagagatggggtcaaagaaaccaggctgcagagctactgatcaaagaagtaaggcaagcctcagggaagctcggacaacgttataagaagtaacaaaccttagctgcataatgaagtgctgtgaggtgggttgatgtggctctcacatctacatcgacgccaagttcagagaccaagaatcggatggcttcgtcctgccctgtgacagctgccctgtgcagagcctgggcacccaggctgtcttctgctgaaaggcaagcctagtgggcagaggagagaaaggagcaaaggtcaaagataagaaacagggcaacttagatctgggcatctgctggcacttcagcaaaactgagctgtttacgcacaactctctgggcagaggatatgtggcttttgtctgattttcaaaggattctttttttttgagacgaagtctcactctgttgctcagggtggagtgcagtggcacaatcttggctcactacaacctccatctccttggttcaagcgagtctcttgcttcagcctcaggtgtgtgccaccacacctggctaatttttatatttttagtagagatgggttttaacatgttggctaggctggtctcaaattcctgaccttagatgacccacccgctttggcctcccaaagtgctgggattacaggcatgagccatcacgccctgctctcaaaaaagggctctctaatcaaaaagatggttatgattcaatgttccaggctatggtgccaaaagcactatcagcagagacagtttgttgttattattgctataaaacagctaccatttactgaatattttgctaactgctttatgtacattatattatttaatccttgtaaaactttctgaagaaactacatttctctccattttacagatgggaacactggtgcttaaagaggtcaccaagttccagagagagagtttggaggggctggggaatggaacctgggatctgagtaacaatgtgctctgcttaacctgtgacctaaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcc

SEQ ID NO: 466 - DNA, 11812 bp, Homo sapiens
atatgaattaccatgcactttattgcctcctcttggaaacatccttatgtcattgcgctatggccagagccctgaaggacatctgctctccttgggagctgctgagccagggtgcccgtgatgtcttcagaatccttcagtcccgactgcaggagaaacttggcacaggccaagtgctgacctgcacaggccagatgcagggctgaggggtgacaaaaatcacatggacttaaaacacaatccctggagcaatactgacctcatgagttgatagtgcccaataaaaatatcaattctttcaatatcttccgtaatccatcttcacaacttcacctatactagatcaaaatatttttgtttctaacctgattgggttgaaaatagttttaaagataacaaaaccagttagagaggatttaagaaatttatctaggctgggcgtggtggctcatgcctgtaatcccagcactctgggaggctgaggtaggcagatcatgaggtcaagagtgtgagactagcctgaccaacatggtgaaaccccatctctaataaaaattaaaaaattagccgggcgtggtggtgcatgcctgtaatcccagctactcgggaggctgaggcaggaaaatcgcttgaacccaggaggtggcggttgcagtgagcactgcacgccagcctgggtgacagagcaagactctgcctcaaaaaaaaaaaaaaaagaaaaagaaacttatctaaagcaagaagcaacagagcaagttaacaagatataggatacatcctcttcatacgcctgaatgctctggaaacacactttaaatggtacaaaaaactttctaaaaggcttattgaatttgctttgtaagtaaaaatatcaccacaaataatcacgtagccaaaaaaacacttttgaacaagcttcccactctgggtgcagaaatcagcactgaggttcctggtgtgctgagttcaggggcactggtgattctgctgctttccctccagcagagaagctgtgtcccttcctgggcagagcagctgccctttccagccctagagtgagtagttaggtacctgcgagtctttgaagcatcagaaagatcccactaggccaggcgcggtggctcatgcctgtaatccctgcactttgggagggcgaggtgggcagatcacttgaggtcaggagtttgagaccagtctggccaacatggtgaaaccctgtctctactaaaaatacaaaaattagctgggcatggtggtgggcacccgtagtcccagctacttgggaggcagaagaatcgcttgaacccaggaggtggaggttgcagtgagccaagatcgtgccactgccctccagactgggtgacagagcgagactttgtctccaaaaaaaaaaaaaaattccactaaacccttgcaagatggcctttggctcacagaatgttagagggtttattttaaagtccaagtctaaagaatttgctctcagcagatgtttctgaatattctaaataaaaaaaatcataatgaatatagtttctaaatatactccaaaatggatgacctgtgaagaattgatacgatacctggctagcaggtgtcatcatggattagaaagaaactgcttttatgatgcatatattgttatggtttaaaataacaacaaagattaacaacagcagttgtaatgagtggcagtcatcatcactgttataataacaattatatgaaggctttgcagagaaaaagatattttaaggaaaagtagctgagctattagaagaataacattaaggctggtcacagtggctcatgcctgtaatcccagcactttgggaggccaaggcaggtagattgtttgaggtcaggagttcaagaccagcctggccaacatagggaaaccccatctgtactaaaaatacaaaaattagccaggcatggtggtgcatgcctgtaattccagctacttgggaggctgagacatgagaatcacttgagccaggaggtggatgttgcagagagctgagatggcgtgccactgcactccagcctgggcaacagagggaaactcttgtctcaacaccaccaccactaaaaaaaaaaaaaaaaaaaaaaaaaaaaaggaagaatattaaaatcattgttttaaatataaaagtgtattggttatactcagtttactaatttccaaggcatatataaaattaaacggtacctgatcgatttttttcatctttagaattgatgtcagctcccaaggataagagagtctgaattgtacttgtatgtccttcctgaattgaaacaaatttgttatcactgtgatgaggataaaagaaaaccttttgcaaaccaaaaagtatctgagacaggtctcaatcaatttagaagtttattttgccaaggttaaggacatacctgagagacaggtctgtgtctctctccaaagatgattttgagggcttcaatatttaaaggggaaaagagggctggagtgaagaggaggagggtatggtcacattactgaatccacattgcaggataaaaggagcaggggggggattaggcaatgatacattaaatatctctttccactcagtaaattggcactttacataagataaggtgaatataaagtagctacctgtggaaatatttaaccctttatctgtagctatctgcttaggaacaaaaggaaaggcagctttctgcatgactcagctttcagcttaattttttttcttttggcagagtgagttgggggtcttacgtttttattttcctttcacactttaaacacagactctaacatatattaggcaccttttctaaaacagtcgactgctaaaagtgaattttcatctttttttccctaatttattcttttttttttttttgtagagacaaggtctcactatgttgtccagactgatcacaaacttctgggctcaagggatcctcctgtctcagcctcccaaagtgttgggattacaggtgtgagccactgcgcccagccaaattttcatatctaaagtaagatattgtatcattctcaattctaatataaatcattaaataaatattttggtgacatttaattattagaatatagatgatcaactctgtgagccaaattactgacccaatgcagttagtttccatcattgtgagcagtacaaatcttgtgatttatacagaacccaaaactctaaaatttcccaagcaaatatactctttgttgaaatctttaggggagagataaactagaaaagatcataaccgctcataaatgggaattcctattacagctagtaggaattattataataaatattttataaaataaaaatattatttatatatatatatatatatatatatatatatatatatatatatttgagatgtagtctcactctgttgcttggctggggtgcagtggcatgatcttggctcactgcaacctccacctcccgggttcaagcgatccttctgcctcagcctcctgagtagctgggactagtggcatgtgtcaccacccccagctaatttttttgtattttttagtagagacagggtttcaccatgttggccaggatggtcttgattttttttttttttttttgacacagtctcactctgtcgtccaggctggagtgcggtggtgcgatctcggctcactgcaagctcctcctcccaggttcacaccattctcctgcctcagtctccctagtagctgggactacaggcacctgccaccatgcccggctaattttttgtatttttagtagagacggggtttcaccgtgttagccaggatggtctcgatctcctgacctcacgatccacctgcctcagcctcccaaagtgctgggattacaggcttgagccactgcgcctggccggtctcgatctcttgaccccgtgatccgcccgccttggcctcccaaagtgctgggattacaggagtgagccactgcgcctggcctataaaataatttatacactctttgtctagccagttagtctgctactatgtgatgagactacagttaaggttccaggttcactcttcctatgggagcaccctgcggccacagagcacatcatgtgtatctacccagctgctcgaaagcaggacatcaggcaggaaaatgtaattgatcagaaaaacaagtaggccgggcatggtggctcacgcctgtaatcccagcactttgggaggccgaggtgggtggatcacaaggtcaaaagttcgagaccaacctggccaacgtggtgaaaccccgtctctaccaagaatacaaaaattagccaggcatggtggcaggcacctgtaatccagcctgggcaaaaaagcaagactttatctcaaaacaaaaacaaaaacaaacaaacaaaccaaaaaaaaaaaacaaaaaataagtaaaagcataaagccaatagataatgttaaggataatatgcaaaacgctcctagcatttaaaacagctacttttccagtgaaaatgtttgcttatcttcaatataccccagagagcctagtaaatgcaattctcttgccctggctgaagagttcttaacttctgaaatccagtataagaacagagagccaggaatttcatacaatgggtatttatagcttcaaataacgttattcctgaaaacaaaaacctgtgtgtgagggggaggcactttatggagtaaaaggcttttttttaaagttttgtctagcaacaaattcaagtcaggtttctatttaaagagataaagcgcttcagaatcctgaccatttcagaagaatatcatgggcaatttcttccatagagatggggtcaaagaaaccaggctgcagagctactgatcaaagaagtaaggcaagcctcagggaagctcggacaacgttataagaagtaacaaaccttagctgcataatgaagtgctgtgaggtgggttgatgtggctctcacatctacatcgacgccaagttcagagaccaagaatcggatggcttcgtcctgccctgtgacagctgccctgtgcagagcctgggcacccaggctgtcttctgctgaaaggcaagcctagtgggcagaggagagaaaggagcaaaggtcaaagataagaaacagggcaacttagatctgggcatctgctggcacttcagcaaaactgagctgtttacgcacaactctctgggcagaggatatgtggcttttgtctgattttcaaaggattctttttttttgagacgaagtctcactctgttgctcagggtggagtgcagtggcacaatcttggctcactacaacctccatctccttggttcaagcgagtctcttgcttcagcctcaggtgtgtgccaccacacctggctaatttttatatttttagtagagatgggttttaacatgttggctaggctggtctcaaattcctgaccttagatgacccacccgctttggcctcccaaagtgctgggattacaggcatgagccatcacgccctgctctcaaaaaagggctctctaatcaaaaagatggttatgattcaatgttccaggctatggtgccaaaagcactatcagcagagacagtttgttgttattattgctataaaacagctaccatttactgaatattttgctaactgctttatgtacattatattatttaatccttgtaaaactttctgaagaaactacatttctctccattttacagatgggaacactggtgcttaaagaggtcaccaagttccagagagagagtttggaggggctggggaatggaacctgggatctgagtaacaatgtgctctgcttaacctgtgacctaaaatttataggaagaaccaaaagaataaaaacacaaccatttttataccccatgttcatcgaggagcagcctagcgacgtcgatgtgcccacactggattgcgtccatcaaggcggtgacgccacagttgtctctgtagtctggttcatattggcacctagagccaaaaccccaagtaagagctgagaaaattcaatacctcaaacccaggggacagttgacacctgatcacctgcaggtgaactgcgtgtgtgcaaatgacctgtgagcatggagctctctctattctcccccatctcagtgtccgaactgagcactaagccttcaggagcgtgatggtcttccctagcagacctgctgctcctctaaccttctccatcccatttgacagcacttggtctcttcagcttcctgcaccagagacctggaagccaccccttgccactgcctttcctgcatccttcataatcaattgattacccccatccttcaattccacagccaaaatatttaagacatctgtgtctgagctgggcacagtggctcacgactgtaatcccagcactttgggaggccgaggtgggtggatcacctgaggtcaggagttcaagaccagcctggccaatgtggtgaaaccccgtctctaccaaaaatataaaaaattagccaggtatggtggcatgcacctgcaatcccagctacttaggaggttgaggcaggagaatcgcttgaacctgggaggtggaggttgcagtgagctgagattgcaccattgcagtccagcctgggtgacaaaagcaaaactccatctcaaaaactaaaaaaaaaaaaaaaaaaaggaaaatcctcaatgtggctgatagcattcattctcccaccccttcactgttcaggctcagcatattctaggcgtcttttgttttcttaaatgtaccacagttgttcctggtttggagcatccgtgggtgctgttattgctgtctggaatggtcccttgcctcccgctttcagctaatttctttttctccttcaggtcacagcttaaacactggcgctgagattctttactcttaagccaaattgggtcttcccattatttgttctgtagggatcctgcaagtccttgtaatgcacaacagactttcgggactccttcatggtctgtctttcctgccagtctgttgagttccaggagggtagaaactacatgtgtcttctttctgttgtggcccttgcacctggtacagggctttatttattttttatttatttttttttgagacagagtcttgctctgttgccaaggctggactgcagtggcgcgatctcggctcactgcaagctccgcctcttgggttcacgccattctcctgcctcagcttcctgagtagctgggactacaggcgcccgccaccacgcccggctaattttttttgaatttttagtagagacagggtttcgctgtgttagccaggatggtctcgatcttctgaccttgtgatccgcccgcctcggcctcgcaaagtgctgggattacaggcgtgagccaccgagcactaaatgaatgtataaatgctcgttgaaaaaaatagagaaatggatgattttgccgctgaaaacattttccccagatatttgttatttttgtttcatattctttatctgctatgtcttttgttcatttttcttttgaaagcctaatttttttcttaaaaatgtgtctgagctctttatgtagcactgatatcaactctttgtcatagttagcaaatattttccctgacttgctgtattgttcttacctcttaagaagcaccttgactgcctccaaatggccatgcattgctgggaggagaaagaaagctgagaattagagctttttagtgcacacacaaaatgcttcctgcctcctggctttgctctctgccccgttctattagtgatagcttacaagaaggagtcattaaattgggtacactgttaccgccctacacgaataaatatttaactggataaagcggtaaacaataatgttttcactttatatgtacacagccaacacttgattatcttatcttcacgtgcactttcatgggaaactttcaatcctaaagttacacttctgtgctgtggatccccaagactagtccatttttgcccaggaaatgcaaaatattgtaacagtaatccatggcaaaatagcctggatttaattcccctactaaaagtaactatactcaaaggttatgactatttgtcttccactattttgggtgaatgatggagtgctgattgtttctccaggggagaaactggtcaaataattcatgagctaaaaaaaagttttctacttacttaagaagttttagaaatgattccttggtccctaattgccaactgtggctcatgcctgtaatcccagcactttgggaggccaaggtgggtggatcacttcaggtcaggagttcaagaccagcctggccaacaaggggaaaccccatctctactaaaaatatgaaaattagctgggcatggtggcatgcgccagtaatcccagcttctcgggagactgaggcacgtgaattgcttgaacctgcgaggcagaggttgcagtgagccgagatcgtgccactgtattccagcctgggtgacagagcaagactctgtctcaaaaaaaaacaaaagacaaaaagcaacactataaaacatcacaagtgatgatttttagagaaactaaaagccctctatcctaatcaatgtactacctagaaagctacaagttatattctgaatttcttaatctagactcttgagctccttaatatctaacttctgaaattacagtaattttactttttactaattgttttctttttactttcttcaaacaaatgagcaaattgaaactttttactaaaataatctacaaatagataattcagagttaagagtcactactccaaataataaaaactgtaacccaaatttacattagatgttattgggccaaggtatttaattatgagtatctatatttatttaaaagtatagcactatggtaggtgttactaaggctatgaggatatatatttccctcctgcctttaagagtaagaatgtaaacatgataaagaaaatagcactaaccagttattttgtgctatgtgccaagcattgtctaaaggatttacatacatcatgctctttaaactctacaacaaccctgagacataccatcactgacattattatttggttgatgaggaaacttgctcaagagagagactaatttccttacccaaggtcaaagactatgtgctacagaaccagctcatgggcaaataatctagggaggataacacagatacacacgaaaaataaattaataccacagcatgctagccaagttatgttaactttagaaattgattatatgccaaaaggcccctagatgctttttttttttttttgagatggagttttgctcttgttgcccaggctgtagtgtaatgtagtgcaatcttggcttagtacaacctctgcctcctgggttcaagccattctcctgcctcagactctggagctccccagtagctgggattacaagcagccgccaccacgcccggctaattttttgtatttttagtagagacggcgtttcaccatgttggccaggctggtcttgaacgcctgacctcaggtgatccacccgcctccggcctcccaaagtgctgggattacaggcgtgagccactgcacccgcgcccccgcccccaccccctcccccccagatgttcttattctctgccttctgttttccaaaatcctcctttcccctgaaggtgacctgaacaagatgcggttgggcagtgctgggtgaagcagccacatgtgtgtactgctcacctgcagagctgtaggctgtacctgcagtatgcagaggagtccttctaattttgctctctgtcttccaggcacctgggcaaacagtgagcaggtactggaggatcagagggtcgccttctcgactggcaatgtggaaactgttccagccatctttgttcttcaggagtggattggcgccatgttccaccagctcctggatcacccccaggttcttccttgtgcaggccatcatcagaggagtcctaaggccaaccaggagaagctgtcagatggaggcagctgagacattagaagccaggggccaggtcttcaaaacacacacatccttggcacagatggaaaacctagaggattcaggggtctggcaggcaggaaaacagctttgaccggcaacctctgtgccttctgtgaggaccctgggagaaataataaggggaaaatgattgtaacgaacgtgtacctagaggagagggtgcctgggagacaaagcagcttataagctagttcacaggatagcagtgaattggagcagagctaagaaaacccacagacaaccctcaacacataacgaagtctattcccctgccccagtggggaagatgtacttccctatgttcctaaagatgttcacgccctctaacgaacctgacctagtgagtactaaaatcagtgtcaatctaacaaacgaaatgcaattggcttgtgtgatggtggagcagagtatctctgactgtggtggttatgcaaggctgcacgtatgtgatacaactgcactgtgctctacacacacgagcgcgtgtataactcaggaattctggatattgattggagcaatgccacttgaaacaatgcattggtgcagaagtaacttagctaaatgtccccagaacatcgcatccggaggctatctgtatagtgcacacacttcattgtttggtaacattctctttggttatattctacactattccgtgctctagaaagggaggtgactgccccgaccagttaacccacaagggcaggaacgagggactctgcaggtcatctgcgttataagggaaagttgggcaggaggtccctgccgctgagcaggcctggggtgagaactaggagctgagaacagctacggtgtccaaggggacggagaagcacagggaactcgctacgactctgcgagtagaggggaggcggggtgtctttccgctccacacctaccagtcggccttcttcaggcagtcgaccgctgccccccggcccagcaggtagcgcacgcagtctcggtggcccatggaggccgcctcgtgcagaggccgcttgtagtctcggttggtggcctcgatgtccatgccccaggcctcggccagataggccagcacgtcccgatgcccgtggcgcgcggcgcagtgcaggagggtatccccggccggccccgggcagcccccggccgcctgcagctcctccttcagggcgcgcagccggccctcctgcaccagcctgcagaggcgccgcgggtccccgggctgggccatcgccgcgggtcgggccgggctgcgcggggaggcggcgggcgggacaccggcggccgggcagggagaagccgagggcgagtgggactttccgcctcttcacgcaacctgccccgcgcgccccgaacccggcagaaccgcccctcacgcccccggctttgtccccggcagagccgcctcctcaaacccccggcctagtccgcaggcgggctgccccctcacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcc

SEQ ID NO: 467 - DNA, 11812 bp, Homo sapiens; identical to SEQ ID NO: 466

SEQ ID NO: 468 - DNA, 1103504 bp, Homo sapiens
ttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctgattctgggcctcctttgaaggaggaagggtgagtcccgcaggattttaacgccttcccttcacttggagtccagagtgtggagatggttaggggtttgcttctgtgtctgtgaagtctctgcaaggaaggggcagtgcactgacattccccgacagatgtggcagagttttttggcaactcaatgtccagcagagaggtgcagtctgtaccttgtgaatatgtgtaatatgtgagaattataaagttgttattggtgggggtttttttttttggccaagtcatctcaagaaattttgttttcacaatattttggtttggaggatgtttttgcacttcactgcatcagaacagatgaacgaaattatggaatatcacatgtaggccctgaagaagaagaattttggaagtttagcaattatttgctacaccttttcccacttaccactgaaaagtattcttcccgggtctgcttcatatgatcaggtttgagaaattagctgattatctcatttcgttgctgaggtagcattatgtttatgccattcataaactaatttctatgatctaaatatctgtataatttcctgattactatataatcactaacacatagcggggtttcttctcaaacagtaaattaacacgattacacatcacaaattccaacatgcataatagcttttccccctggtctttatgtatccgtctaatagacgtttgggttaattgaatttttataaaactcagcaccatgccaagcagagtctgcctgtgatggagagtgtgtcagttcttttaaatttgtgtctggtgggggccaattatttaaatttctggttggcatttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattccccgagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcctttatcccaagtcatgagttttgaatcattcacaccacatggtgggaagttaatataaaggggattgtagttagctgtgatgcctaggattgggggtgcattactacattatcaattgtgttagttataccttttaactagaaataaatgtaagacttgagaggtaaagttcttacaagcatccagagaatgtttggaaatggaaaactcatgttgtttggaggaatcatattctattcttgtgcttctaaggggaaaaaacttcattgaaggtacttagttttgtccctcagtttgccagtcaaaagaaatataatacatagttgtaagttgtggcacgttttaaaaaaatgggtttttaatgagctggagatctttttgcatgtaatcgagtatgttaagaaatcacaaagttactgccctggatttctgtagctattgtgtgtgcttggcgatttttgtgttatatgatttaaagtaggatattgcttttaacctcaaatagatttagctaagttctaactgaaatcatgctaaaagtttctcctcgcatttttacaaacatagtgtttcttgtaaaactggaggataaaagcaaataatatcagctattttatatgatgtaaattcagtaaatctgcacttggaatattgagtgtaaaagtgtgtgtgtgtgtgtgtgtgagagagagaatgaatgaatgtgtgaattcatccagttgtgtggtgtcagataatgccattcagaatttgccaggcaaagaaacacagaaaaatggaaaagagagagagagagagaactagcaagaggaaagaatgagaatgagaatgggggctgatttgttctggttgagctgcttctggtcagaagatttcagggagagtgatggagcagaaggccctcacctaacatgaagctgccctgggggcgtgatggttgtgtgcaggcttgagccataatgctaggctggagaaggaatagagcaaagtcattttgtgatatcatacccaggggaacagtttccagctctgctgctctcagctgctgtgttgtttcctacaagttgtttgctagtgtagaaactacacatgcaacagattagccttagggttgagttaataaaaatctttcctcttgaaattcctttttctctttccccctcatctaatataaactccggaataatgtcgataaaacaagaagctctttgaaaaatggacctttggaaacagaaactatgagtgtattttagaagacaacatggaaattcatagcttaattgctttgtagttgaagtttgtataaatgacacttcctttacagttatttaaagtgtttgtagtcttcactttttctgttgctcactgaacgacctaagaaatatccttgggttttatgttcattggaatgcaggataatttgctgtccgattaaatctctattattcaaacaagtcattgtttgatgtgctacacttttagcttccaaagcattgtggttatatgaggcagaagctgatttccaaaaaggagtacaaacactgaggttgaataacatctacaattgggctatgccagatttgtacatcaattctgatcttacaagccaatataagtattttatatcatatgatggtagaatgaagatgtatacatgtatgcatgtattgataatgtaaacatctttatcaaatatttatgatacatagcacttgctctttttaatatcttcagtcactatttaataaagtgtgctaaccttatggtgttttgaaaatgaaagaaaatgctgcagagattttccagtcagcattaaagaaaactattcttaataaaagctatattaaggaaatagaaacagtaacagatatagcctgactgcttgtatgttgtaaatacacatgtaaatttaatttcccaagtgtttgtgactgctctttttaaactttataaatcttgctgtcaaaaatctataccggatttaaaatagctacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtagggaaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattttcttcctgtttttttttcttaattataaacataatgtcttttacaaccctcttgtacatttcaatgacaatttatgaactgcttagatatccaaagatctctaaatcctcatagcaatacttagccttttatttgttttaaatatggttgaatgatctgaaaaaataatctcttttgatagctcttaatgaatgggtattttgattagctttgtatagataaatgataatgaaaacaaaaagtatacaattagggttcttactgattcaagcaatttgttaccaccccaaaatagtgcaacatggcttagtgaaagtcttcataagaaagtaaaaactaatttacaatgttcttatttcctaatcacagaaatgggcattgtggacagttttcaaccaatatatgaatactctaaatttgtgcatacatattgttactccgcttttatgttataacatgtaagttaaaattactattatgaaagaatatataacctggctagtttacccccaacctctccagaatatcagtcgctttatagtacttgaacgtttgcttagtgacacattctgttgaaatctaatgttgaattatttgtggatttacagaatatacaaattcacaaataattgtatgactaagacaaaacttggtcattttaagttgagggattgtcctagttgagaggttgtgttttcatattgcctaagttgttgagtgctgtagtgcacttcaagtaaatctgtttctgaagacttgccccctggattttcgtccctaaattatccatacaggttgaagcagataaaatacaagaaattttggtgaagttgaaggttaaaaatagattgactagtctcttcttggcatagatacaattattaggaaacagttctccctaatacagacttgccatccaggcatcctagagagagatgcatatgtggtaatttacattaatttttggtcttcttcaggagaaccaggatatttttccctacggaaaatagtttgttaggaagttctttcctggcccttgatttacctcatttggacctagtaaaatttatactttgttttaaattacaactaaaaaatcaaaaagaagaaatgttacctacagtctggatggaccgtaagagactgtcctactactttctaactcagacttctgtgttttttcttttcttcttctttatttcccctatgaagatactacaggggaagccttgggtaaatgatggggcccaggagtggattgtagtgtatgagtttaggattgctagtcattatcatatggactagccttctctcgaaaccttgaaattcagctgtccgggtccaaggaatgttggaaaatagaggtcttagatcacaagactgtgaatgcaaatggtctttctgtttctgatggagtctttgtccatcccatgaggacgtggatggtaacctgcattgcatctctagttcagaggctttctctccaaagcccaaggctctgtctttggacatctgccctggcttgctgggaacaagaaaacagctctgagtggtgcatgaatccggagctagtagccaggtttatgaggtagcaatggtccaagggaacctagaggagggaattgtttccttttcttttgctctgctgtgctagaatatgtgagctgaatcaagcccagtgcaagggaacatacctgatgagggcactagagtcttggtactgggtatacctaagagcccaggggatggacgagggataagaaatgtgaagtactgtcagcttcactaaatttggaaaatgcataccagtaatactatcatcccaaatggttgtcttttatctgggaattgccattaaggcaaagatagctaaaaaaattgagggcatactaaaaccacatagttataactaccacttatggagttggtaaatttttttggcctctttgatagacacatagagtttgatttttatgtgtagattaaattcctgttgaataattaatgaataaatgactgaaggaccccagctggttggatagtggaaatcactgttctagcctaaatttagaaagataaaaacatacttttgatttttttctcttctcatctctgatatggtgagtttgataccaggacactgttcccttctcttcccatccagagccttactgtaatctggatcgacctttggggcttcagagaaaggttgtttaatttcccaaaacttttccctcacttatttttagaacaatatttgttctgtgtagcttatagcccagcaggaaaaaaaaattccagtgttgtaaatgcttaaaagtacagaagagttttgctgtagtctatgaacccttaccactgttttcagcagaaccatttgtaaaccatcccagtttattttgggtgacagacttcagtattcagaaattttgtgttctccttggatctctcttcacaggtgtttaaccatctcagtactgtaagtgatactttatgttgaaattcattctcataactgaagatggaaaaacacagcttatatccctaagaagtaatacaaagaggttttagatcagttcctctttacttatttttcttgtttccaatatcacaacagctcttggtttacctgcaggtggggtggcatgtgcccatttgggctctgatgaataatgaggttctttgccttcacttcctcagtcggccctggaggcactgtgggagatgatgtgttatcagtgaagcagcagatgtggtggcagcattttcctccactgcagggagcatcccgtctgtacctctgtacagagcaggggagctgtctactgagaaggaaatggatggctgtgtttgcttcacatagaatttctcattagccttgggaagtggttctggcagttggggccccttggtggttgccaggatggagaggttctgctcagagtgggtgtgctcattgtcctgtcatctgcacaaagggccacagcattgagataacctaggcatgctgctgctttgcaagcccggacacctccggacaatcctttcctctgttgtcttcattcccatccatagagatgggtcacatcttgtcctcaggaacactagcacctttctttttgttggagcagaaattttataaaacaccctagcattttggaatatagttttattccgatgagcagtttagaaaaatttatggtaacataaaatttaccattttaaccatttttaggtgtgcagttcagtggcattaagtatttgcattgttgtgtaaccctcactgcaatccatctccagatattttatcttcccaaagtggaaactctgtattcattaaacactaactccccattccctttcctccttttccccaatcaccattctactttctgtctttacaaatttgactactctttttttttttttttttttttttttttgagacggagtttcgctctgtcgcccaggctggagtgctgtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctagatctcctgaccttgtgatccgcccgtctcggcctcccaaagtgctgggattacaggcgtgagccaccgcgcccggccctacctttcttaagtgtagagttcagcagtattcaatacattcgtaatgttgtacaactatcaccatcatccatcgccatactcttgaccttgtaaaaccaagactctataccaattaaattacaacttctcattttctcctcccccagccactgacaaacactattctactgtttgcctctctgatttttactaagtgcatcatttaagtggaatcatatggtatttgtccttttgtgactggcttatttcacttaccataatgtcctcaaggttcatcatgttgtagcatatgtcagaatttccttcttttgaaaggctcaataattttccattgtatgtaaataacacattttgtttattcatccatccatccatcagtggacacctggtttactttcacattttggctattataaataatgctgctgtgaaatgtcttctcaaatccctgctttcaattttttgggtatatacacagaagcagaattgctgaaacatatggtaattcttttttctttttttcttttcttttttttttttttgagatggcatctcactgtgtcgcccaggctggagtgcagtggcacgatcttggctcactgcaacctccacctcctgagttcaagtgattctcctgcctcagcctcctgaatagctgggagtacaggtgcatgccaccatgcctaagttttgtatttttagtaaaaatggggtttcaccatgttggccaggcaggtcttgaactcctgacctcaggtgatccgcctgcctcggcctcccaaaatgctggattacaggagtgagccatggtgcccggcctcatatggtagttctaggtttgctttttggaggagctatcatactgttttccatagcagctgcaccattttacattcccaccagcagtaaacaagggttccagtttttccacatcctccctcacacatgctattttctactgttttgatactagccttcctaatgcacgtggagtagtggtgagcagtttttatattgttgttgttttctatacagagttagtgtctctaattacactgtcattaacaagaagcaaaagttctcagaaaagagaggtgttcatttattcaactcttagtttaaatagcatgtaagatcctgaatctgaaaccatgaaataaggaaattacaatggataacagcttaataaaaacaatgatttaaagagtaagcttagaaataaagaattgagtaagcttcgatttaaagaataagcttagaaataaaaacaatgaaagatgtaaagaataagcttagagaatggacttacagaaaacagtcctccaaggtcatcatgagaatattgtatttttattcatattgctatcagtgtagtccagaaaggaaccttatcatactttgattagtttcagaaccttttaattgatttaatgtattcattaattgcctctaccccagcaatttccctgtctgtattcctgtccattgccccaatccccttctaatcagtacgcaccagaggctgagtcattctaaaatactacttttttttttgtttgtttcagacagggtcttgctctgtcatccaggcgggagtgcagtgggacgatcttggctcactgcagcctcaacctcatggactcaagcagtcctccacttcagcctcccaagtagctggtatcacaggcccatgccactatgcccagctaatttttgtattttttgtagagatggggttttgccatgttgcccaggctggtcttgaactcctaagctcaagcaatgctcccacctcagcctcccaaagtgctgggattacaagcatgagccactgcacttggcctgaaatgctacttttcttaggccttgttccctacttagaaagtttcaatggatgcaccatagttaactcaagatctcaacattcaatatcctccttagcctcaataaagccttatctttctcaccttcccatatgaacacttcatccactctgactgctccctgaacaggccaggcactttcctaaccctcctgtttttacatatgccatttcctctgcctcgatcttcttccaccctcatttctacctgtggaatttctgttcttccttctagggacagctcaaatcctactgcttccataatgaaactagtaatgattcctaccagggatatgcactctagaatttgaacacagagctcctctttcctgtgtaccttacacaaggtactgttacaaattttccttctgtcatattgtgtttgttacaatgtatgtattttaaaatttttctctgtttctgtgtgtcttgcctcactggcagccaacactattcttgtgtttggatactagcagggtcttcagcttacttgccagtgaaaagtgccctggcctcgagtcagaagaatcctttccactttcagctttgtagttagtacctgtgtgattgtgggtcgctgactttattcactcatttgggtctcagtttcctaatatgcaaaacgagaaggtaaaatgcttttcaaggtccgtttaaactgtatttggtcctcagaaatgacccaaacatagaaatctccttcttctggagctttttctggagcttattttctcttcctctcctcttatttagtgttgttctcaggagaacacatgtgggaaaacaactgtgaaacttttagacactctaagagaggagaaagagagctgaatgagagggaaccttcaagggaaggtgtctcttttctccaaatcttatctccatggcctttttgtgtcatttaaaaaaatattaacagttatttgcattcgctggcatcgtcttttcaaaaagcaaatatgattgcctctgcaagcctgtctttgaaatgataaagtatgattaatccacagctgtattctttagaatgagaaagttcagtcatttgtggtgctaaaatgaaaaaataaagatttgaatggttttactatttactgtgaatttatttttacaatgtagatggggcattgttttaggttctaataattagcactgttgctgaaatggatgaggtcagcacagagagtgtggagagcttggttttcaggggggtggcagcagttctaatggctgcagggcgaggcttcctgctgagatgccagtgttgggttctttctcaaattatgatttttatggtttgggcaagaaaaggatgcatttaagctcttttataagtaaaatgagcaatgctgaaacagttgtcaaatgggaataatttgatctgacttttacaatttctgcatgaagaggtattggcagctccatggcattggggcaggatgggcagggcttagctgggctaggtccattttttttttccttcagtttaacgtctccgacccctggtggattcacctactgcagaagagccaatgctgcttataaattatgtttcctcaatctatatctctagcccagacctttctttttggctctctatctgaacatctaactacttacctggtaacttatgtcctacaaacactttatgtgaaatattttaaccagtgcctcatctccactgccagtccctctgcacatttgtatcctaataatgactctaccctcactgctagtatgatcaccacagttattcccagtgacttccttggtcgacacttatttggtgccagagtagtaggcgctgagataaattcagttaacccctcaccatatggcagcattaatattttttagttacctcaaaccagatacctctcctgctccataccagattagtgaccacatcccactgattctacgtccttaacaaatctcagattcgtcccgtcttccctcacttcaacttctctgtaatagattcttactgcaactgtaacagcctctttatgcatggattctttccttctcacatccattttctatactgttgctagagtggtctttctaaaatagaatagatggtactgtgcttttacctaaagcttttcggttgacatcaggataaaactcagacccctttgaatggcatgtgagggcttttggcttttgtcccaagtgttcttgtccagttctttctcctatccagaaccttgtgctacactgatggcattctctacatatgccaggcagctttagggctctgtggatttgcacatattgttctcttttcccagaatggtctgcttctctatctacctgtttgttgtactgtcactacctgtcatttcagattgactgtccttccgtggaatggttaaataacactggatagccctataacggattgtgctatagtctttacaaatcttcttgtaggagaaaatatgatgacttagagatatgtttatattacattgtcaagtgaaaagtgttgtataatacatgtgtgattgacttttctttctttgcttttccttttcttttctctttctctctctctgtgtctccctttcctttcttccctctttctccctcccttcctccctccctccctccttcccttccttcctctcttctctcctctcctctcctctcctctcctctcctctcctctcctctcctctcctcccctcccctcccctccccttctctcccctcccctcctctcctctcctcttgtcttcccattgatctttcaataaaaataaaagcctagaactctatgtagctaaacgttaacagtgtttatctctgggtattgggattattgatctttagaatgatcttcattttgtattttctaaagtttctataatgaatgcacattactttttaacaagaagtagtaaatgctattttcaacaaaaaatactgacttgtggcaagtactatgtcttacttatctttgtctttttagaacattgccttcctcatggaagatgtattagttagggtaggctaactgcagtaaccgatgatacccttaatatataacaagtaaaatgcgatagtttatttctacctagtgaatgaacagaacacaagatgttctggtcctgactttcccctgaataaaatctgcactaactaacaccgaggcatagccaaacctcacctccagaccaaattggctgaaataggcagggttccaatttgtgacggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgggtgagttttgcaataaatcttcaacgtttaatgctcactatgtcttgtttcatttgatatcactgaaaatgcagagggtcaggccacattcactctgtctctccctggcatgttaggttgccttctagagctctgtgtttcacaaatcattttgatgtagagactgtggagaaatattctcaggctttatcactgctgacttaattgagtttcatgatgcgcttttttttttttcatagtaggataaattaaaaatggctgataaagctgcctgtaaaagcaaaattgttaggttaaacctgcctggtgtattaaatgtattgataagtaatttggccaccatttttaatcacttttattaactctcaagtagttttatttccagtaacttgcaaaataactgtcattatggactcagtcatatttctctttaaaatactattgaaaagtccatgaaaatgattaaagtgccaatatcatccacctacttcctgttagcaagaattgttggtgattttgtgattagctgagtatatggttgtgctctctttgtgcaacccaggaggaaatagaaccagttcatcccaggtgaatagagataatgaatgggtttgaagccgtgtaacaggagtagtcttttgtgcatctgtatcatgtatgttattgttatgctgtctttaaaacattttattaaatattgagaagacaagatacttgtgaattatgtgtaaagtgtaaagaatcatgatacgtgtaatgtgcctttcggtgtcatctttgccatcggctgttcggctttgtaaggatcttgagttcaaggtcactaaagaacagcttaacacattgtcttgctcacaggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtctgtgcagaaacaaaaaattaaatttgccaggcttggtggtgtgcaccttcagtcctagctactctggaagctgagtcaggaggatcccttgagcccaggaatttgaggttacagagagctatgattgcatcactgcactctagcctgggtaacagaataagacctgtctttaaaaataaaaaataaaaaagaattccctgtattttttccaatccatttgcatagcctccaaatcccattcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacacaaataattatataattacagttgtgctaagcctcatgagggaaaagtacaaggtcccagccaggtgaacatataacagaagaatctatcttagtctgaaagatacaagaaggtctttttgagaaagaagcatttctgttagggtagggaggaggggaaaggaggagaggaaagatttgcatttccaaccttggggcagagaaggtgaggaatagcagaaaggacagtcagcacaaaggaagcaaaaatggggtctgagaagtaaggaacaatcagacgattctagacttccaggattccagattttatcttaaaaacaggggaacccaatgaagggtttttaagaagaggagttatatgcttgtcatttcaaaaacatcacaactgctggttataaggagaatggactaaaagggaataagagtgcatgcagggagctgaggtggggccccagttgagactggatgtgtgcctggactagagtgggagctacagaagtgaagagaagtgaaagatttgagatgatttttggaagcttcttttagccttggctgtgatggggcaatgcctacaaagggcggtggggaggatggcccccagtgttctggcttgagcaaattgtatgcacagtaggtgatgcgatggcaaatactgcaggagaagaagcccttgtttagtgtattgtcgacatatccacatggaaataccaaggaagcatgtgcttgtttggagctggaggtcagaagagaattccaggttgtcttttgagtgtggtggttttggacaaggacatgacatttctagctccatgaagtagataagattgcttagggaaggtgggagagtgtaaggaaaagtgaagagaaaaggaagcataaggaacagccacctttaaaggtgaggcagagtgatgggaaagaagcaattagagcagtgaaaggaagacccaaaaaggattcaggagggaagagtggctgctgcatctgtgtccctcgaacatcctgatggaagaggaggaagacagagcccaaaccaggactttttgagtggtgactattgccacacattttaaatgtaagagtgcacattgcatttaggaccagtgaggacttaggacagagttctggccaatgccagaggtggagcccagaccaggagcagactgaagtactatttgccaacttccggttaagattgggttttagtaatatttttatttatctggacataagtagcacaaagctgttttaaatactctgaggctttctttggtggtgggggataagactgggaagaataactaatttgagagacccaatggatagtttgtataaagatatgattttcaaaaaatcatcaaaattgattaagtgttactaacgtgttgctgaaggtcactcgtttatgtgtttttctcctgagctaagaattctttcctatgtaccacctaagccctttcagtgacaaattattgttcaaatttttcttggcacactgacttgagaattaactaccattcatagctggtacccaggtcctatgagaatacaatgccttgtcacataaatacttgtgaagtgacatctatcaatctaatttagaaaaatatttgagtcaaaaggtccttgaaccatgtattaggttgacacaggagctccctttatctgaagctgtgactgagcattttaatgaatggcagtcaaggaattcaaagttattattctgatagtaattgcgtgcatttttcctgcccatctatatgcagccttctcattgtctaggaagctgctgatttgatgcattcatagctattatttgcatagggaatttgaaccaccatgggaagaatgattttgaatttcctgttttcatttatttactttgggtgcaataacagtgttttcatggaaggattttttatattgggtttttcctaattttaatacagtgtaaataagctaagtgttatatttctgaaaaccacacgttacaaatttttaaaaatgggggaaagatgaaaatgaaataaaaagatgggaagacaagttctgaaacctctgaccttacctgcgggctcctccctctagttgaccatggagaaccatagatgacttactgggccagatattctgatcttggacagaccaatggtttgtaaaatgggttgcatattatagtgtgcaaattcctggactagacttccagagatgatagttcatgtggcccagggtttgtcctgagaatctgcatttttgaaaagctctccaggtgatttttagtgtgcacttaagtctgggagctcttggaattgtttttttcaactaataaagttgaagacaccctgcacaagattagaagatggataagaaaagagaattagaatttactgagtttctattatggctgaacatgtttacatatcttacgtcatttattctttaacaccatcttgcaaggtatatcattttgttccaattttaacctgagattcaaaaaggtttacagaactttaaaggtcatgcagctgctgggaggcagaacctttatttgcctccaggtcatctgatctgctgtgtagaaccacgacaaggctgggaacaagaaggtctggatagaattctagtcacaccatcacttgggtgaggtccttttgccctctctgccaacgtgggtacctgttgctaaaggtagactttcctgtttatcatcaaagagtgcctataggtagatgagtggggaggactgcatacattttgagagtagtaaaatcagatccacttggacaaaactgtcttcaatattctacaatgaacatgccatgttattgtgaccagaattgacattgtatctctaccctacgctgacaagttgattgtctgagcgaggaaacagcactcatcatacatttatatttctccaggaaggaaaagagacatggtagagtctagtggggaaaaatctggcttcagattggacttagtacttgaattaagggtcaggcattggcttctacctctcactctgtactcatgaccttgggaactccatgtttctaaactttatttttagttttctctttgtaaaatgagaatgatgtgtctctctcagatcagtgagtaccagctgagatcatgtctgtcgagcacttaggcagtggtaagtgccttctttctttctttgttttgagacagagtcttgctctgttgcccaggctggagtgcagtggtgcaatcatggctcactacaaactctacctccctggatcaagcgattctcgtgcctcagcctcccgggtagctgggattatagacatgcaccgccatgcctggctaatttttgtattttttgtagagacagggtttcactgtgttggccaggctggtctcgaattcctaacctcaagtaatctgcctgccttggtctcccaaagtgctgagatgacaggtatgagccgccacacctggccacagtaagtaccttcttaatgttaatcagcagagggaagggagagtgactctctgcagcaggattcagtggagctagagatccagactagcaatagcagcagaatgaagatgaatcttgactacttgattgctgcatttttcattattttaggaacccagcggttctcctaaaatgcatgccaaaggtcctttgacagggtgctgctccagctgtggtttgtcggtctgcagtgttgtaccaccctggtgctcattaggactgcaaattcccaggtcaccttcagatgtaccactctccagatgtttctcatgctcactgcagtatgagaagcactactttaacaggcaacctccttccaggtgaatcatgtctggagaagttgcttggtcagagagatatttgtccaggctcagccatgctggctctgcagcgagggttccttcactagaacaccatgcatttgtggtggcagcataggtagaaggcactgagcggaaacaagaggagcgagatggagaaagaaaaaaaacaactttcccggaaaagttaaaatgatagcatgacctttctgaatggactttgggacatggcaccaagaatgagcaataatgaaataccaaggaaggagactccttaggagagcatctgggaaccatgcaaccatgcgacaagaggtgatgcagggaagctggtgagagggtgaactgaggctcccccaggggcgaggggggatacctcctttctgaacctcatgctgaacccgaccctcaggagcaacagattggggtaggagcttttggagaggggaattgaaatggccttgttggcagaatgactctgaagggaactttccagcacacccaggaaaaaaacaaaacaaactccccaatctgccagactccactttcttaactggagggcagggtggttgctcaaatattttgggctcagggctttggaaagatttcttgtcttgctgcatgctctgtggaaccaggctgagagcaggatttttgcatttagaatatcttagcagaactgggcaagatgaaaaccaatctttttgtagctaccaaaaagtggacatacttcagctttctgtcttctccctgctgacttgggtgtatttggtgtgcttgctctgtgctaggcccttcctgtctcttatctcactaaatcttgacaatatccccagagattggcatcattatactcattttacagatgaaactgtctcagaggggttacggaatttgcccaagacacacagctgagtggtgaagctggaattcagaaccaagttcggcttattagaaagtattcttatatactacatgtagaaatgaaacgcaacgtatgtgacagccattataatgtaaataataaaagtaacaggattttctccctgccctccgtaattcagtatacttgttgattatttgctgcttctggcaagctatgattgattgctgttctgtgggatatggagaagtttgaggaatttatgatacagctggggagaaaagacatattgatgcttgaccaggattaagccaccatatctcacaggtgtttagacaaaggagaaggcacctctgctaaggcacatcagggaaatctctagggaagatactgatttgacatagtactttctgggtatatagaattgtttcattttgtttgccgagtatgttaaaactgtttgcagggtgtgttaagatgatttgcagaagaatgttgcatatattattcgttttgatttggaaaaacaattaaaacaaggagagtcttattatttgccctatctttgggtaacttctgtactaacaaaactccggctcaccagccactagagttaaaattctcactaaagaaattgactaaatggaagagaatttatttctgatttcctttttaatgtaaacatatgtattgacacttttccttggaagaagtgtagtttctcttttagtagaaggaaatagaattatactctggcttaaattctattattataaacatacttctgtttttatcttgagataaggctttcctatatactgttgggagtctatagtgatatagtcattttctatattatttggccatcatttattcttttaaattcatttataattgtttttgcatgttttattgctaacatttaatagtgaccacccattaaagctattgcagtacctaagtatttataaatttttctgacatgttattgcttctggattataaactgggaaataattaagattcttgttcttgttgtaatgctgttatggtgatgatttagtatttccccaaacagtttatataatatggtctttttccacattggtatgtttctttatttgctggacagggtattttaatggttacatctaaatggaataaactcatagagctgttgatttgagaaaaccttctataatgccatattaatctatttagctcccagacctttcttagcagatcaaaggaatttcctggccactcccagaggtctgaccgccttttatctgttttaatgaaggtaattaaaattcctcagcttatgaaggtctggtcctggtcctaagtgaactagtccccagcagaatctgaaagaggactataagcaagccatttatttctaaatttttaaccttatatttctgtagatcctgattaaggtagttcctgcagtgtgagggcaaacttaggttgccagtattttagggaaatatgagttcttctttcataaactctgatgattattttgattcctgtatcattcatttgaaatgaacctgcaacactttgtgggtacataggaatgaagcaaatgcactctaaataattaaccagttgtgtcattgatttctactgataggtttatagcaaatgactttacacaaagttattaattaaatgctgtgttctgatgttgtctaaaaaatgtcatctggatgtccacagtttaaatcctcaacaaaatgttaaaagtcacagaaaaagtctttgacatagcatgacttaggatctccatattcatagttatttgttgagtaaatgtgctttgagcacttatcatgagccaaacactgggctaggtgttacagagacagtgctgaacaaagacctcgccaatatggtgcatattcccattttacaatctgtcagctcagccagtctcttaaaggccatcttttcctcaaacgagtttctgaaatgaaaatgaaaagagtcatttaaggatttaatctgagttctagtctataccctgaccacacaatgggcctcagggagaagaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagcttaggtctgcatctgaaaatcagtgatttacgtagtcaacctttatgaaagttttctttgattagtcaatctagaaaagcataggctttattttttttaatttttatttctcatgcttgtgttttgttgcattgcgtttatcctggatgccttaatgaaatggtgcgatatgacccagggctctcatctgtttaactttgctaatttgctccattttcaaatgagtttccttggctgcaggagcagcagcagagcatgaactctgctgaaaggaatttcagttacaccgctactgccacctctggggcccccggataattttcttatcgtctttttgccgtttgggaacaaagccacgttgttcacgactgaaatacagtttttaaatgtgcctcctaccgtgtttttatagaaagagagcctcttctcctggaaaataaaacaccattgattgaaccaacagcccttcgaaagggctttaattattgcattaattacaaacttcaggacaaaccagggcccagtagtagggagccattgagcagatttctgagcggctttaaagaaaatgttaaaagccttttagatctaagaggctgaaattgagagaaggaggtgggcatgtgggagacactaccttcttcaagttataagctttgcattaaaaaatatcctcttccctctctgatttgtgtttcctgggaaagctccaatgactcattgctccaaggcctcaacattttctaccctgacattgatgagagagaggaaagtggggaggtggtctaaatgtcatagagtagaacttctccaaaaaaataggtcactggggaaaaaagaaatactcttggaataatcctttaacatgatcatcttcaaaatgctcactttttattctgaagaaaaagaagaaagaaaaaaggcaagtaatttctttctctggcaaaacattcactgaggtgttttcattcaattactttgatggttggctgttgggaaaattatcaaaagtgaatatgggtttgggaactactagaagattctcaaagttgctttttatgatctctttcccagggaaaataaatcattaaatactgaggtggctagatgaaattgaatgctacatctcatggtttattcagaatgggctcttccatctgacatccttttgacaggttctaccacatgtggcatttctggcaggtatgagggtaggtttcacattctaaaatgaaactggcagtcacacgtttccctggtttaaaacattttagcacttattatgtgccaaatagtgctctaagctgtcaacatgttaactcatttaatccttacaacaattttgtgaggcaggaactattataactatttagcagataaggaaactgagccttagcaaggtcacagtggagagcaggctgtccggctccagtgtctacttaattctaaccgaatactctgggagacaaagacgttcgtctcaattcatatcaccttgaatattcattgccagttgatgattgttattcttaattccctgcaaagactcaaccagtcaaacaattaatcaaatactgatttaccaattttctgggcacaagattaggcattaggagatgagtaaagatcccattcctacattaggagttcccaatctaatacagaagatggataagcaaatagggtgccagaggttggagtttgtggctcagatttgggagggttcatttatcaattcattattttaacaaagtgtagtgctagtatatgccaagcactgtgagtgattcccccatcccctgctcctcagtggttgcagtctgatcaggggagatggataagcaagcagcatgttgcattttggtgtgataattgctgtaattatgggcaagtacatgcaggggtactacatttgtaaatgtaccaagggaggtaatggcctgttcaggaaactgcactgtgacttagcatggctggagggtccagtgaaagcacagagaaggtaagaggtgaggctgcagaaggccccagaaagggttgggagtcaaggacattgtctgccatttcagagactctggactccattaggacattgagaatgttacttggtacccagcagtaagagttccttttcatccaagctctcatgtcactttaattgaaaagtagaaaagcagaaagaaagagtatcctaaaattaagcaatgataagacactgcaaatttccgaagattggaaattgccacttttatgtagagcttatggctattttctcgctggagacagactgaaaaagtgaggtccatatctgtgtctatttctgggatattggctcagcaataaagatgttagaaaaaataaaatgatggggttaaaaatcaacacatgtcacattaatttctgattcttctattggaagaggatcacatttcaaggtcaaaagatggagcagtgagatttgtagagagaaaatttatgggtggatatttgaaaattttctataagtaagcattgagaacattacgaagctaccagattttgtaattttcaaaattacaaggaatgtagtggaattggataatggatggtggaacctcttattcttggatcattggtttagatagatcccagattggcaataatggaaatttatttcaattttatgtctgctcagtggctgaaatgaagtgggttaataggtgcagttttgctttttgtggaggaatgccctagtcacagaaacccctaaagcaaactggcctttatatccccccagatgtttttccaggatgggtagtaacagagagggatatctctttgtcttggatttcctttatattgtgtgtcaaaatggacagtgtacaaagagtactattcaaaagtgtgagactaatctcagtttattgtgaaattcaatggatcacaaagtactgtgtccccaaaccaaaacagatgattggaaaattgaagactagatatttggaattgcttgaatgctggaggatggtgtgggcaggggtggaggcctgggtttctggcatgtaaccctaaagtcctttttatctttagtcttgtattctacctgagtagtaggtattgtgaaaagtatgttttctatgagtttacagatacagttcctggcataatgtacagcatatagcaggaatcctgtaatcattgaaggagttaataaatgatatcatcagcatagaacagtttggctgctttatgtataactcaggctactacagattgggtatctcttatgggaaattcttaggaccagaagtgttttggattttggatttttgtggaatatttgcttatacataatgagatatagaggggacgtgatctgagtctaaacatgaagttcatttatgtttcatatacaacttatacgcatagcctgaaggtaattttacataatatttttctttttctgttttttgagacaaggtctcgctctgtcaccccaggctggagtgtagtggtgcggtcatggctcactgcagacttgaccttctgggcacaagcgatcctcccacctcagcctccctagtagatgggatgggtctacaggcctgcagcaccatgccaatgcccagctaatttttgtattctttttttttttgaaatggagtctttcccttttgcccaggctggagcacaatggagcaatcttggctcactgcaacctccacctcccaggttcaagcgattctcctgcctcagcctcccaagcagctgggattacaggcatgtgccaccatgcccggctaatttttgtatttttttgtagagatggggttttgccatgttgcccaggctggtctcgaactcctgggctcaagcaacccttccaccttggtctcccaaagttctgggattacagacatgagacactgcactcagccttatacaatatttttaataattttgtgcatgaaataaggtttgtgtacattgaaccatcagaaaaaaaaggattactgtctcagtctcccatgtggacagtctgtggttttttggcatcaccgtcactcctgactctgaatttatatgctactgataagctttgtgttcttacacttattcacgcataagtacttaacagtaaaaaatatgacatgcatatctggtgtgcacagaaaagatatatcacagatgaaggaggctgggagggccttttttcccttggggacattgaataaagcatgtgtgtgcacctgtgttttgattgcgactggtcacatgaggattgggtgtggaattttccacttgtggtgtcatgttggtgctcagaattttcagatggtggagtatctcaggtttcagattttcagatgagggatgctcaacccataaacccatatagagataaggagtcttggtacaacatgtgctttatagaaaggaaaattttaggtctcagttgtagacttagagaaattcaggactaagacatttctgtgcatttagttccttttcatttttattttcctaccaccttcccccagccagctttcatctttttctctcaaagctctgcaaatcattgaaaaaattttccatgttattttttaggacaaaaacttactaaaagtcatccatccagcactgagttcttactcacgggggtcaccactgctgtgttctagttcctttgcttttgttttgttcactggcccctcctctccaatccctgagctcctacactgcaggccttcctttttattttacgttttacactctcccaacctgactttatcctttcaatcaaagatcattaataaatcttgtattgccattacctcataaaataagtattccatttaatcacattatctatgtatctgaaatcaggaagataccgaaaggtggtaaacaggaaatgggaatattggcagaaatgtactactgtacagctgagaattgtcattctctttgtttttttttttgtcgaaaataaaccttctgacagagatgatcagagaaagggatcataagtggtttcatatgaatatcaagattggctcccattacattttggcactaggtgttaagtttttatctctctgatcctgataggtggtggtacttggtgggcagtgtcatgaaaaccaagagaaccagggccttatatttcttttattttaacttgggtttttattttttttctttgcaacttttatattatgttcaagggggtgcatatgcaggtttgttacttgggtaaattgcatgttgcaagggtttggtttacaaataatttcatcacccaggtaatcaacataataaccgataggtactttttcagttctcacccttctctcgccctcaatccacaaataggtcccagtgtctattgttcccatctttatatccaagtgtactgaatatttagctcccacttataagtgagaacatgtggtatttggttttctgttcctgtgttaattcacctaggattgtggcctccagctccatctgtgttgcttcaaaggccatgatctcattttttttaataactgtaaggaactcaaatcaacaaacaaaacataacttgagttttgagaggtgttttctaccagatacttccctttgaactttgtatgtgacttcctagagagaaagtgtgttgaggaagttcactattctattctgcagtgagagaagacgacaggctaccagggaaaaatagaagatcaaaacctttttatttatttatttttgtttgtttttaaagtatctgtttccatatgtatactattgtgcaaccaattagttggggatagcggatttttatgtagctggcaaacttatcaggcagaagagaattatcatgtatatttcagcagcaatttatgaacaggtttgtttctaaaggatgcacatgtattttgggtttcactcttagtttcactctgattaatttgcttaataaatcttccttcttaaagacagaggagaggcaaacacaagtcaagcttttgttttagccagtagatttataattaatgacttttgttgatttaagaagctttctgaacaattcttggaatgcagtggtggcatcatgaaaggagcaaagggaacattttcgtgggacataagtaagatttaggagagggaggagttcacagactatcattaattttacaggaggagaaaatcaatgtcagtaggaaaaaagatacgtacaaaagatgacttctggatttgaggaaccattctcaatagcagaaaatagagctgttctcaagacatatgttaggtctctcacaatctatcagcaataaaaaaagatagcaatatagagatgaaagaggaagagagaagaaggattaagatcagctgtcaaaatgttgcatacaaaatgtattgaatgtcactattataagaggtcttactgtaattaaatttcctgtctatttggatttgctcatcttaaagctttttcagttgtcagtgtgagaaatgtttcctatctaggtgttttttcctccctgttaagtatcagcacagtgtaattcaccatagttgggtagggtggtactgagaatgtttcctacctcagcaagcctaatgtatatgattgctttttgtgaagagttttttttccatttctaccattaacaaggtgttagacacttagcttggtagtagacaaaccattagatcaatattcccagaactagagagttctgatattggcaggcattatttattccattaaaaaatgtcatattcatttaacaaagatggaatgcagatagtttcaccgaagccatgagtgtgataaaggctatagacaaaagattcctgtgaagtgaccatctggaccagtttaggtgttaggatttctgaggttcttgaacaagagctgttcctgctagctcatgttttagaacccatgtacaggaaaattgaggttgtgtttaaaaaatatggcatgtagcacaggaaatatgtgttttcagagcaaatgataacttaatattggctgaataatttgtaagaatactgatttttttgtcatataacctatatattttcttaaggaagataggtttataaggaaaaattgcaataattaaactgagcataccaacaaggaaaaataatttaactattatgatgactcatttagttggcatcctcgagtaatgaggtgctctagattaattttcctgagagcagaaatatatccctttaaatgattaagcattttatcttcatcaatctttgaataatatatttccaagatatattttacattcctttgtgtcataaatatgctttacaatgtatagggctagaatcatagtttttttttttttttaagagtttaaagaaacactgggagatcttggaaaataatattaccacattggagtgcaacattcttgtctctgatatatgaggttttgattagatgatcatcaaaattccttctctttctaacattctctaaataaaaagtcgtttatgttttaaattgtagtatatataagaatcagctagggtctttgttaaacttgcagatactcagacatcatccctagaggttctgatttagtagatttggtgggagagaagagaatccgtatcataaataatcacctagagccattctgatgacctcatttagagaaacactgattctctttccactcttgtataacagacaccattactcttgctggccacgtggtccttgaaaagatcattgctgctttaccctcagtggcattgagttgtgaggggctgatgagactaataactatgctttgatagtctttgctttctgaacctttcctcagtattacctgtcactttgttaatggtagctactgaggaaaaccagatcatcaagcttattaaatcagatgccctgtacttgtacatttaataagtcattgagttctaatcttaggtctgggtagaggcaggggaaggactgtctattttctcctgtagtctaaagtgcatgcatttagcagtgatgattatattccctgtttggaggtcttttactcttttgtcatgttctggttgttttaagaaagtcaagttttctagaagcatgacgtcagaataagtggcacattactctataaatatcttaattttcatggtgagattcatagtcaggatggtctatgactttcaaatattaaaaatttaaatataccataaaattctcctttaaagtatactgttcaatgatttttagtaaaatctgtaaatttagagttgtatgaagccaacaccataatctaattttagaacatttccatcatcccccaaaagaaatcaggtaactgttcccactcctaaatccagtcaatcaataatttacttcttatctctatagatttaccttttctagacatttcatatgaatgagatcatacagtatatgcccttctgtgtctggtgtctttcagttagtgtaaagttattgaggttcattcatgttttagcatgaatcagattgccaaataatattctgttgtatgcagttactacattttatttatccatttaccagttaatggacatttggattgtttccactttttgactattatggctagtgtgttcaaatctttgtgcagacatacattttaattctacttgagtagttttacctaggagtagaacttctgggtcatatggtaaatctgtttcaaggtagcagtttcacatgttacagttctacccgcaacgtataagggtttcactttctctacatccttgccaatacttattattattattggatacaagtcccttattggatatatgattttcaaatactttcacctagtcagtgagttacctttttactttctgaatggtgtcctgtgaaacacagtatattttattttgatggatccccgtttatctttcatctatgcatctgggtactttttttttttttaaagaggaatctttaacccaatactcatgccttcttgaggcttactcaagatcttgtaagctttgtttagtatgaagtccctagtgatacctagcatatagcacctagtttaaacagattacagatgaatattcaaagtttttgacctgaatttactgtagtcaacagttaccctaaagccttaaagattaccaaagccatgatagactcagccaccatcatgcaatggctatgtccttcgtagcatcctttcttcacattcatctttgctttcagcatatgaaggggggaatgtaggtctttaatttaccttgtactgtggggtagcactatcctttccttactccattttcaggcccttggatgcaggacccttctctgaggtcccacagaggtggaggcccagcctgagcttttacaggttttagagtaagatgtcaggacagcagttcacactcagccacatcccattaaaagaaataaaaaagtggctgggcacagtggctcatgcctgtaatcccagcactttgggaggccgaggtggatggatcacttgaggtcaggagttcaagaccagcctggcccacatggtgaaaccccatctctattaaaaatacaaaattagctgggcgtggtggtggacacgtgtaatcccagctactcgggaggctgaggcaggagaatcacttgaacctggaggtggaggttgcagtgagctgagattgtgccattgcactccagcatgggtgacaaaagcaaaactccatctcaaaagaaaaaagttgctgctgtagagttttgtcataagaacatactggctgcagtgtccataggcaaagatgaagctttactgagggctgatatactcaatacttctgcccagtccacttgagtctgtctttgcctaaatactaaattgtttgaattctcctttagttttagattttccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattagacccgtggctaatctataagcagtcatttatattttaaatgaaatccattaatgatatattcactttctagggcttatttccatctcaagcttccatttctgattgtaatgtgtaatgttgcatttcctgtgaaaggaattccaggctttggattgtaggtgggtaagattagtggtgggtcttagagagtcgggagatcctgagcatgggaacagccttttgcccgtaagtttatactgtgctcaaagatagtctgaatagttttaggctgcctggggtcccaaggagactttatgcctcccgatagtaaattttgggtccccaaagacccaacaatatttccatgcgatcatagcttgaccccaatttatggatgcttccttcctttcttctttaatccttgacaactttcttccccaagatttcctcgtgtcagggacccagaggccattcttactatgatctctttcttttccatttcattccctatggcttagaccatttaggtggggcagtggttctcacagtgtgaaccactcatcagcagcaacagcttgttaaaaatgcaaactcaggacccaccccatatctgcttaatcagaaaggcctgggaggttgaaccctccagtccgtgtttgatataccttccaggggttctggtgcatgcgcacatgtgagatccacttgtgcagtggttaagagcaaggattctggaatcagcagccaggtttcaaattttagctctgccatttggcagctaccacttcctgccatccatttacctatatgatctttggggaaattactttcctctctagactttaatttcctaatctgtaaacttgtggaataaaatatgaattacctacatgggaagttgtagaaatgaaataaggtaatgcatacaaagtgtctcacgtgatgtctggcactctgcaagcatccctgaatgggagctttcatggttgatatggactctgaccctagtcattgcctgcacagtgcttgatgaccttcccttgcttgtctctagcagcttggcatttaactactcaattctaaacctgaatgtttgccatgtgctccattttcagtagtatgaaaatgagactagttttcacactaaaatccctgtatgaaatatatttgaaattttgcttaggtcttgcttttgttttctgccacccagccagtttcctatctgggataggacatcgcttttgataataattcaatatttaaagcctttgtttaagaatgtgtcttaagacatgtttaaaagtctaaataaacattatatcctgtctcaatttatctaccacttaaaaaatttcaagtgttttttatctatctatgtctatctattgatatagaatctatgtagggatatagaatctatggattctaaatagattctatatagatatggataggtttgatatccctatctgtggcttttctcctataacatttttctaacttaattgtcagaatctgttctctagtagaaaatccaccgatgtcagaggatcacttgagtctgggaatttgaggctgcagtgagctgagatcatgccattgcactccagcctgagtgacagagagaccctgtctcaaaaagttcatcaacatacagtatacttccaacaaatccacagtaaaatttaatgtattggatcattttcagactcgcggcagccagtccttgggctatttctatgagtctttatgtaactttgactacaaattcgaagttgtcctcaaatccactagaactcctggttggataccattcaatcctggtgatttattttacttttatttgtcagttaggcctagtacatcccttgcatttatttttcctgaatttagcatatttagactgcttacttcagaagagaatttgttttcaaatattctctttggtaaaatatacctcagaagttggatttattccctttcctatcttttattcatctatgtactgcacttatttttataagttcatctgattcttcagctggctttctgccaatgataaattaaaaaaaaaaaactacacataaacgaaaccaacaaccagaaaacccttttaacttgttatttatttatttatttattagcaacctttaaactctttgaattatgtcatgaatttcctctgacttacaagctcacagggcagcattttctaatagtgttttgttttagcctgaaataaaaggttccatggtcaagttagcataggaaaggctacatacttattctatgcccctttatcccctagcctctgaaacagtttagtaattcataattcacagtagcatttgaaacactctgagatgtcctgcatagacaaaccagattaacttggtttgacctaatttcccccccaacataaacacttattaacaatctgtgaactagtgttccttagaccacctttgtgtccattgaatttagaagttttcttattctcatttggcatagcttaatgtttttagatgtgctttagttttttcctctttacctatttgtttctatttggtttcttcacttacgctttttccatatatatttttttgacaagtctgtgtgacccaatttaaacttttctgatgacatttactttgaattaaaaaagattttttgttcattacttatcttcctatattctatattgaaatgattattttaatatttaatgttatagcatattaatttattaaagtattaaatatttatattattaaatttattttaagttaaataatcaaataatattgatattaaatatttaaatatttatatttaaataatatttaattttaactttatattgatataaaattatttaaatattgataaggatattactttggtagtactggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacagactgctattctacatcacagtttatcatcatttatcaaaattgtcatgtcctctgtgacatgtttctttttctgaatattttattgtcacatgtgtcattaagcatttagaaaaaaaatggcctggaatcttcttcctgaactgatgaaattcatgatttttgtgtatagacatttacaaataaattatatgttgttaagaaactaatggtagttttttttcttttaaaattctcacttcaacatcaataaaaaatgtttctgaaatggaaacataccattttgatgtctaactgcatctgacacttttaagttttgctgtcctattattaatattttaaagttttaggaagggctactttttatataatgagattttatattccataaattattatttgactttgttttactttgtcacaatgcttcttcaaagcttttttgccaaattggctacctttagattcctttttaggaaaggtcttcaggatggtcttttttgttgtttttgtttttgtttttgttttttgagacggagtttctctctgtggcccaggctgaagtgtagtggtgcaatttctgctcactgcaacctccgcttccttggttcaacgatttctctgtctcagccttctgagtagctgggattataggcgcccaccactacacctggctatttttttgtatttttagtagagatagggcttcaccatgttggccagactggtctctaactcctgacctcaaaggatctgccagcctcggcctcccaaagtgctgggattacaggtgtgagcctctgtgcccggcccaggatgctcccttttaatagctacttaggaaattaggttttggtaccttgttgttagaagagaatattcctgaaaaaaggaaacaactaaatgcatcgactatctggggtagtagaaagagaagcgacagcacagagaaaagatgccccttagggaggagaaagaaacaaatatcaattagacttgaacgaactaggtttctttattgatgaagaaagttaagccacactttaactttccttgccacactaaaagcaaacaaacaaaccccaaagaatagtcaagcagctgagacattcagtagccttgtaggcaaaacaagacatattcttattgttggagtatagttgtgtaaggcctgtagcccctttcttttgactaatttattccttttggaatgaaaatatttactcaatgcctgtacctgatctgcagactgatcagctgaaatcatccttgattttatttctgatagggagaacctgtcctgcacttaccatggtagagtagtgggtgtttataatgaagatgtaaaactttatagtttggatcatgtgggaggtagactctgatacagggcttagagtgtttattagggagtgctgttggaaacaacacaatggaagagaaaagaatcaggatcagacagatggaagagtcaaggtgtttctttggccaacaacatggaagctttagaactgaaatggttaatcagtttagtgccatgtttggccaaagtggccaggtctttgtaaaccacctccattagtaaatggatgcggctgtcacctcccacccaccagagcatgaccttaggtcaggcgttctctgcagctcagactgttccagcccctaaaggggcttacagctgggattgtcctctgacaacactccctacatctgggccaagaagttcttccttgaggattggtcttgatggtgtttctcctatgtctgctgcactacatcagtcattgtccccttaaccttcacaaaagcttttgaaaatatttatattttttgtttataaaagtggtacaattagacaccaatctgtattcaacagggcaatggttaaatccatgactttggagactatgtgtgctcttgtttgaatgtttctatctcccccagatttatatgttgaaacctgatctccaaagtgatggtattaagaggtaggacctttggaagatgattattagatcatgagggtaaggctctcatgattggattagtgcccttatataaaagggccaacggagcttgtttgtcccttccaggacatgcgaaacgcagtgagaaggaaccatctgtgaggaagtgggccctcactcaatctgctggtaccttgatcttggacctctcagtctccagagccatgagaattgaatttctgctgtttgtaagctacccgtcaacgatattgtcctagatccgcccaaatggacaaagacaatttagaattaacataatgaggaaatctgtgtgtactgatgagaaaatatgtccatcatgtcatagactaaaaaaaccagtttgccgactatacacatatatacactatgattatatttttatttacaaaagctatacaagtatgtaaaatacacaggtacgtgtagattcactaaagcttttaccttctgaagactgggttgggggtaaacaagaagagagaatgatagttttcaatttttgttttgtatgctcagtttatatgttcatttttctgttgctgatgtaacaaattatcacacatttggcttaaagcaacacaaattgtttatctcacagttctggaggtcaaaagtcaaaagtctgtcttactgggctaaaatcaaggtgtcaggagggctgtcttcccttctggaggttcaggggacaatctgttttcctgccttttccagattctagaggctgccttcattccttgacttgtgacttcttcctccatcttaaaagccagcagactcacatcttcaaatctctatctaactctctcttccgcctccatcttccacttcaagaatccttgtaatttcatggggcccacccagataatccaggataatttccttgttttaaggtcacatgattaacaatctaaattccatatgcacctttcttaccacttgccatgtaacataacacattcataggttctagggctttggatgtgaccatgtttggtggggtgttattctgagtactacactaggtaagtgaaactacagctttctcacaacctatgtgctagctgttcatgcttcctgttcagataataccaggtaaatgagagaagagaaacatccgtgggtaaacaattataatttagtacattattattctttaatttctatagtatttataataaagttcaataagaatttatctatgaggaagtggcttttctaaacaagtgtaaagcccccttgtttggaaaaatgtcagagagactgcatactttttcttcttgcccgcttttcccatgctggcctctgttgcagctcttctgaaatgtaatcattgctttatttctttatttatctctttcctaattttcttggaggttctttaagatgggggctatatactttaacttaccaacctattcaatgaatattcattaagtacctattatggctaactatttttctgaacatttgggatatataaattgataaaaaccaataaaaatttcacttctttaatggaggaaagacatcctatatagagggtgatgaatggaaataaactagaacaggtcaagaagaatcacaagtgccaggtttagggattgtttgtaactttaaataggttattagaataggccccattaggatggtgatatttgagtaaaggctttgatgtggtttgggtgtgtccccatccaaatctcatcttgaattgtagttcccataatccccacgtgtcgtgggagggaccctgtgggaggtaattgaatcatgggggttttacctccatgcttttctcttgataatgagtgagttcttgagatctgatagttttctaaggggcttttcctccttttactccacacttctccttcctgctgccatgtgaataatgatgtgtttgcttccccttccaccataattgtaagtttcctgaagcctccctagccatgctgaactgtgagtcatttataaatttcctctataaattacccagtcttgggtatttcttcatagcagcatgagaatggactaatacaggcttggaggagtttaaggagttagtcatggggtgtcagagtacgcttcattaggaagatgctatttgagtaaagactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagatgttgaatacatactgaagggagccaagggtgggaggtgatccgagagagtgatttttctggtgtggatcagggtggtagcaatgaacgcgatgtaaactcatcagattgtggatgcgctatacttggaagatagggcaagtaaggtttgtggacaggttggttgtgggatatgacagaaagaggttccaaggatgatttcaaggcttatagtttctctaattggaaggaggaagttgccatcaactgaaataaggaaggctatgatgagcaggtttggtagagaagatcaagagtttgtgttgggcctgttataaagttgagattctataagacttccaagggtagatggtgagaagacaatctccagatatatgaatctggagtttaggaaagaggtctggaatatgtgtaaatatgggagccatcagcacataatagatgctgagtgaacgaagagactgcctgagattatcaaatgaggcatagatggcttgagaatgagactgaggttggagtcctgggtcactctagcagagattagggtaagaagggaaaccaaccaaagagagtaagctggagccctctgcaccctttttgacagcagtaggtagtagatgtttatttagtggataaatgcccaaagaggaggtaaagtagcaaatgacaaaggggaattttatctgtctatgtagaataaattaaaaggtgaaaaacagaatcaactgtatttatctcatcagtgaatgggtaggaagcaagtgatggaaattaacataaaagtagatctgaggccgggcgcggtggctcacgcctgtaatcccagcactttgggaggctgaggcgggcggatctcgaggtcaggagttcgagaccacggtgaaaccccgtctctactaaaaatacaaaaaattagctgggcgcagtggcgggcaactgtagtcccagctactcgggaggctgaggcgggagaacggcatgaacccgggaggcggagcttgcagtgagccgagattgtgccactgcactccagcctgggtgacagagtgagactctgtctcaaaaaaaaaaaaaaaaaaaaaaaaaaagatctgttcctttttactctataaatatatttgtttataaaaataaccgttaattttaataagttaaagtgtttttttcttatgcaattacttctttttaatcttcatgatgcttaatgtgctggtgtggctaattctttgaaaaagtatgtaaaaaaatcccttctctacagagatgaatctagttcttcagattggttattcctatactttttatttgtttttgtttttgtttcagagacagggtcttgctctgttgccctggctggggtgtaatcacagctcactgcagtctcgacctcctgggctcaaggaatcctcctgcctcagtctcctgaatagctgggactacaggggcacactaccacactcagctaatttatttattttttgaagagatgaggtcttgctatgttgcccaggctggtctcgaacttctgggctcaagcaatccccctgcttaggcatcccaaattgttgggattacaggtgtgagccacccatgcttgaccatgtgaatatgaatatactggagaatagcaacactaagtagttgaaactcattttagaaattaccccatgaacatatctaaattcttcataatgagtcatagaagaatttctaaagtcaacttggtaaaatgtactgatgattttcattgaaaaagcatgattttgctttcatatatttaataatttgtagaactttcaactttcactgtggtcttaactggtattaaaggtgatttggaaattgtattgagcatgtatcttgctatagtataaaagaagtagacattttccttaagaactttatattctaggttaaacagttaaaacacttatataaatatacatataaacagtttagttgagaaaatataagatgatgtaattgcaggtctgtttgactcccacctatctcttttgagagaagaatttataaaagaatagactgaaaaagtggcaataactataaacttgcattttgacaggaagaagaatagaaaaggaagcagaatcagctgccttgatatggatacaagttctacaaataggacagccactatgcttgaatagtagtagttcacatacttcacgaagtaaattaaatgtgattatattgggcctgacctgttggtgagaagtggatgtctcagcgtggggaggtgtgtaagcttgctcaggaccaaaaagagccctaggtagtgaaatctttgtgaggggttggaacctgaataggaaatagcatttaacaatgctcatcttaaaaccgaaaacctcagtttttttatgagtatgttaagaatctctgaagatacaacctgggttggacgattacccaagatctgttacatatttaacatcagggaagttatgcaaagcttattattgtttcttgtgtttattttgggtgctgaccttcagaaaggccttagctaatctccaggtcaaagcctatagtgaccacccttgctgccgctgcatgccacacctccctctctgtgctatcttgctgcatttagggactttgttgtcatagttcctctcttactgcaaagggattccaaagctcttgaaaaataggaagtagctcatccttttctatgggctgaggggagcagtccttgatttacgataagaaaattctataatctttggacctttgatagaggtgacaaatacagagatctttcttggaatataatttgtccaaaactattttgagaaagcacacaaggcattaacatttacatttccaattaaagcatagggaaactgtttacaacaaggggacagaagttgatgctgttgtttattgtgttatatgctggttatagaccctcgttttacagttatttctctaaaatgcagtaaaaaaaaaaaagaatgcctagcaacatagcaacctctatgaaatgaggcatatgctgtttctaagactcacaatatgtttttctgaactgtttgctcataaacatgtttattgtaggtgctgcttgggcagggacggctttcctgtagaaatcctctcttgaatacactaggttctggttcctcttgtggaagaatgaagctctttttgactgccttggaaaatttgatactttcaggtatttatgacataatcaatggctgatatgtgtcttcaggatttatgactgtcctgtcataaattgccgtagtttcagagtgcatacaacatcactgtctttttattactgttattattggagacaggctgtcactgtgttgcccaggctggagggcagtggcgaggtcttggcttattgtaacctcctccttgccagctcaagccatcctcccaccttagactctcgagtaggtgggactataggagtgtgccaccatgccttgctaattttttaaaaaacatttttgtagaaatgaggttttaccatgttgcccaggctggtctcgaactcctgagctcaagggacccacccacctcagcctcctaaagtactgggattacaggtgtaaaccattgtgcccagcccactctgtcttttgaggtggtgggaaggtgagatgtagtgacacagatattctgtgtaccatagtgataccttatttatgaatcatcttgctctctctcttgaagtctctctatgctagaaacatcatctgatgtggtattcgacacgggttcaccttctggttttgtcactaaatgctttatgactttgatctcagcccttctctgtgtctagagaattgttaaattactaaattaaaatgaatttttgagagtcttttgatgtcacaaaatgtaatagctgctgagtgcccaagtatatatcaatttttctttagtgaagaagatgcagaagtggtaaaggagaggctgcttttggagagggcagagtgagaggagatggaagtttggaaatatgtcttataaggaaggccaatgaggaggcaatcattctgtaacatgtacttgtgatctagtaaagcttgtgttttgtatagaaggctatgtaggcttttatgactgggaacgtgtgaaaataatgacctagagccaatggggcatagggacatttgcggcatctaacccaggtctttttcattcccaggctagggggctacaattctcttctgaaagttacttggcatgatcatcttgctgttcttaaagcaaaatagcccaaattttgttgaagaaatgttttagagaaatgattgcctcatatttctaacaccactcttggttatttgtttactaaatagctttttattgggggaaaagtgtatggaaatttaagttggggaaattacttgggagaacttcttaatgtattagtctgttcttgcactgctataaagaattacttgaaactgagtaatttacgaagcaaagaggtttaattgactcacagttctgcaggctgtacaggaagcatggttggggagccctcaggaaacttacaagcatggcagaaggatgaagaggaagcaagcaccttcttcacattggcagagcaggaggaagagagtaaaaggagaagtgctacacacttttatttatttatttttttgaggcagagtctcactctgtcacccaggctggagtgcagtggtgcgattttggctcgctgcaccctctgcctctcaggttcaagtgattcttatgcctcagcctcccgagtaggtgggattagaggcatgcaccaccacgctaggctactgtttatatttttagtaaatacggggttttgccctgttggcgaggctgatctcaaactcctggccttaagtgatctgcctgcagtggcctcccaaagtgctgggattgcaagcgtgagccaccatgctcggcctacacacttttaaatcttttaaataaccagatctcatgagaactcactcactatcacaagaacaacaagggggaaatccacttccatgacccaatcacttcccaccagatccctgtcccaacattggggattacaattcaacatgagatttgggtagggacacagagccaaaccatattactgaggaacaacttaatgtagatagtttctgtgtatgtgtgagaataaagttttcttataaaccattctattttttaagttcaactattttatcttccttaaagataggggggttgaaagttgattttatagtttgagctcttgttatttttcaaccattagccaataaatataagtggcaattatttaagaagaataacataataatcaaatatgagaaatataagaagcttagaattgtggagttggaagggacaagtcacctcaatttatagtcagcatttatctaattgttctgccccccttaactgtaaaatggcaaaagtaatacttgatccataaatttcttttaaggattaaaagataatggattaaaagataatgtatacattcaaaaatattttttaagtgttttgtttgtttggtttgttttttcaagacaaagtcttactctgtcgcccaggctggagtgcagtggtgctatcttggctcactgcaacctccgcctcactggttcaagcattctcctccctcagcctcccaagtagctgggattacaggcatgtgccatcatgtccagctaatttttgcatttttaatagagacagggtttcaccatgttggccaggctggtctcgaactcctgacgtcaagtgatctgcctgccttggtctcccaaagtgctgggattacaggcgtgagccacagcacttggtctattgagtgtttagtatgtgccaaggcatatgctggttcagaggatatatctgtgtactagaaagaagatcctggctttactaactaggagggaaaaaaactttacccggtgatgacaaaggtgataagtacttccacagtgctcactgggacaaagtgtcagaccttacacagtacctgatactaggggagaaagagggatggacctgatgtgtcttgggtgtaaagtatacccattatataatcctaacagcaattctgtaaacctggtcttattttccttccttttacagatgagcaaacttgtgttcttgtaggtctgtgtcaagtaatgtttgttaaataagttaatgtgtaaatggaaacctgagcagttgtgcaacatgcccaaattcttcagcaagttagtgacagctgggaccagagctgtttctgacttcagcccaggggtcctttcattattctacactgcctctcagagtgtgcataggtgtgtgtgtgtatgcatgggagataggaaagttgcagtcttatatatgctacacttatcaatataaaaattatttcacaaaacacaaataatagtgaagtcagggctcctagtttaatccattttaattcctatcactagttacaggtatatttaattatccagatacgttgactttgtgctgtggatttagtgtactaaataacaggatccaaatctgtgaagttttctttttctggaaaactactggctctgaagcaatttaagccagaattcaaggccattcatccaaaatttaaggtgttctgaaatagaaggtgtatatatcactttacttaatgtgtgggttgtgtgggagacttttctttgcaaattgaatcattggagaccaatgatcctataactgcatttgaaatccttcagctggcaaacctttggtagttttaatttctttctcaaagaaaacatctgttataggtgtctgtagtctagttgtgtgtgggctaccatttcaattagtaaagctataatgacagtcttgggattttgtagaaaccctagtaatagatagaagtgaacatttctaatcctttattatgatcccgttatcaatttcaagtcagtttcttccctatgccatctatccaccaactcccagctgtcttgaaagaacatatataatatttttctaactttagggaatttcttttaagtttgagggcctctttctttttgctaggaagggaagccgggtcaggaaagcagaggagttagttttggagggccctccttttgtgcatcatttagttgcagacctaagcaatgtctttaatcccaaggaaatgatacaacactcctggagtcttccacggttttcagaaggtgagtattcactaacagtacctaactctgtcccttctgtaatttatgtggactctaaacattgctgtaaagtactgctggagaaatacaagacttgtacatttttcttttcttttcttctttccttccttccttccttctctttctctctttctttcttttttttttttgatggagtttcactctttgttgcccaggctggagtacagtggcacttaaaagtcaacctgaatcgcatttttctccagtctgcaatagtttgcccaaataattacagttttaagtcttttaaatggttactagtccttccagcacagaaaggtgatgcagccccaaataatgtgtatgtcggtactgtcactacagtgctttgggtcgaccaatctcatcctgacttctgatctggagtctactgtcatagaaaggtataatatgcttataatttttctcccccaatatttctttgcttctctgtggcagtatttctcccccaaaacacttagagatgtttgattttatccttgcagctgttataaggcagacaagctcgagctgacacacacagtttctctcatgacaaggaccaattgtgatttatgaccatttacaggatgctagtgatgtggggaagggtgtgtttttagctagcaaggctatgtcctttcacttggaaataaacaacatgttaaaaatatgtagcagggttaaaaagaggaagcttcactgtaattttcgtttagtgaagagcccttaggctaactttctataatgttcagctaatgtgtttatatcttcaaatcatcttaacaaatatttattgactgcctgcttcttgcaaggtgttatgctggctgaaatgaaagttttcatgaaaattctaatgtatagaattaggaagttagaaagcggggttattagcatgggtctttgtctgctttagttgaatagaacctgttatgaagcaatacattttcctccaaaaatttggcttctttagcaagcagcatatcaactaaagatgaaagaaagaagtggaaacatttattcacttgtaatgttaatataaatctttgttttcatcagaaattcctgaaaagctagattataatatgttacagtacaaccttgggtttggcttttagcaccaaggttaaacaaagatttatgaacacaaaagatgctgtgaaagctcagattcctgctaaaccttgaatgtcctatagtcctctaaatggtcctaaatgtggaaaaatcagtcttctcattggttaggacccactgacttccgtcattgtaattactgtgatataacctgtagggtatgagtgattaaataatttaatatcactgggagagttacttattatgtgttttatttgtatatttgcaagcagttcttcatttctcatgacagttcttgcattcatcatttactaaaatggggttctgagttaataacatttttttcctcattataaaaattctcagaacaagtcaagatctaattagacatcttcaatttattaaatcagacctctttacagagcccttttagaagcccaggtaacacttgttgttttaaatcactggcccaacatagtcacatgaatataccttgatgcaaagaagacggtgaagatgtaattttttagcctttgcatattaaaaaaaatcagaattctgatagtaagaaaaacatattgtttagttgcccaagttgtgtctttttctccacctctgatttcttcccaatactttgatgaagtactctgatgaagtactcccaatactctggcgattttctttttcttacccactataaagtgtggtgtttgcacttcatgcctgagtctttctttctgagaagaggctcctgcaagtctttggcagctttcaactacattaattttacaggtccatccttgaagcaaaactttaaaaaggtattttatgcttttttccttcctttttttaaaaaaaaaatttttcaccttttaattgtcagttctaattatctgtgcaaactgattcaggcagaaacatacaattctgagagaaaaagggaccctgggactgacaacctaggtttactgagtgggagaggcagaggtgcttcccaaataaaaactgtggctgttaccagaagaagggaacagggatgctggaaaaagaaaggacagacatccagttctggaaggtttatttggcttttattcataaaaatacgaaaacctttccttggttttctgctcttaatcttcctttaaatacatcaactagacatagtcgatataggtggttcttgtaagataaaacctccttggccccatgcaggtactctcctgatatttatacacagaattgcccatgtctcttaaaaaagagaacatctgatttgcctttaagaaaaatgtgcaggatggggtgggaatgagggtgggtgagggctttacatttcatgcagttgcagactttttggaggcagcttttactctctgggtcatattttaattcctgatcctgaagtggaggggaatcctgatgttagtgtctgggtggtattcttgatagacttttagttgaataagtaaggaaggatgcttacatgaacaaaccttattcagtgtcccagtttctgagcagcccaaggcaccaaagcctaacctaggatgaggatggtttgtgtggagctggtgaaactacagctcccgatctcatccaagattgttgttttccatttgctgctgaacagctgtttgtttggctttccagcggcatgaatatgcccacataatcacaaactcctagatattgaggcatcttaatgagaacatagcctgattttggaaggaatggaatgaaggaggccaagtgaattgcatcagggtgcctggtagaaaaactggcattagaacctcgattctatgctcactgtccgtgctctgctccagtacatgaaatttgtcagagaaaatgagatgaagcaccatggtttcctatgccctccctgtttgttcctggtacttaaccaacctaaaatctactcatggatctgtcaggttttagatttagtaacaggctcattgactatggaaataattgggtgggggctgaggtctttatggtagattcaagtaactagagcaagagtagatgggttattgtggtagaatgagggacatttgctagtttaaatcacatttctgcagtttgtggttggacttggagcttctttttctctgtagcttagtagcagatgcgcttttcgctgctggagcaaaactacctacagtagtgtgaatcagcaagtagggagtattattagtcatgtgaattcagatacttcctattgccaaaggcttgatatattcatatcttacattttatcttctctgtgacgattcattacatgtagtgagagcatatacttagtcttctgtgtggctcaactgggggcacatttggtctagtccaagtaattatatgtaacgtaaaattacatacagcacagtcatcaaagaagctgtccttccttcccctatcactaagatctagggtgactctggagtgccactgtgtgaacatttctcactcttgtgagcatgtttctaaatcccaaatcaatctgacaaaggattttctgtgaatttcttgttaatttcttgacataaaagctcttatgaacatacatattccgaacttaattctttgtttgagtcaaaatcatttttattcaagagggaacaattatattaatctagatttgcctggtaaatccataacatacagacctgaagttcaagcagaacccgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataacagaaaaagaaggaaaaaaaatcaatacaaaacaaccatttacttatttcccagagtaatgcttctcaaactttagcaatgtgcatgcaaatcacctggcaatcttgtaaagtgcagattctgattcagtagtggtcaggcagtgattctcaaagagtgttccttggagcagccttgttggaacaactgtgagcttattagaactgtaaatttatgagccccacctaacctattgagttacaattttattagatgggcccaaaaagtgttttaggaagcttaccaggtgattcttattcacctgaaagtttgagaatcactgacatagaggagattctctggagtttttctcaggactctggtattttctactgtcactgggcttacagtatacagttgatctttagcagtggaaacagttggacagagatctttatttaggctcctgaatggctgtcggcatcttgaaagttgactggcttcattaaagtctctatttcttggtcctttgacatctattatgataaccctgatactttctaaagcagacatgccacttcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttttttgcagacttttcaggggtatggatactatatgggctttatatcttcatatcagcttagtcctagttaattgttattttcaatcatattaatggccattggtcattgctagccagtatctatgactggctggttctaatggctacaagcatgcttagcagtgccctcatgaatgttgctattattgttgaaggaggaaaacattttaataattggaattggattttctcagtattcagtattgcaaaaggtggatgtaacttcttatgatgtctcaacagctattactttattttttaatttatttttaaaaatcttattgtcacaccccatgattctgcaacagctataattttaatttctgaaagttttgatgatttcctccaaggctatagctggagaaatgtacattgtctattattagtaacatttctcaaattgtttacaaggcctgcagtatagatgggctgagactgtgtttatgctttttcattgagaaattttggtcttgcagaaggaatccatttgttctgtgaatctctataaagcaaagagaagagttcaaaatttataagggagcccaacaagtgttccaaaaaaggctatttaggcacaacatttaggtgcttatctagtatgttgtttctatcaatacatagcttaaatataaatagatctaagaaccttagttaagacgaaagggtatagcataccatgctataaaatctgtcatacagaatacacataaagtgtctgctgtaattttgtaatctttccaaaagcaatatactgtgtctacagccctcatttacaacttatagaaatttactcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaaggacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaactggtctgtagacctgaaatagataaagctgtgggcagcattctcttctattcatttgttcctttggtcaggaatctgaattttgagacatattcaataaattatgcatactcaaatatttgtgctcttagcttattgccacagaggaaaagagattatttcctactttttagtatctctctgcttttgtctgatttgtacaatgttgcctaattaatttttcttaaacactttgccctccacacattttgcctaaaaccttcattggctcttgtaagatgtgctagcattctagggtctcagtttactgttgctaccctacttaaatgaatctccaatgcttcctaattgttacttcttggcttcaaccaatccaatgagtttcctttctctgacacatatcagatttatgcaaagtagtttcttggcttaagttgccctatatttctacaaaggtctagtcagatggtcagatgtgactatctctacatatgggtctgaaatctagtttaggaattctatgctgtgaatgttttagcttaaaactctaaaatttaactagttttttgaattctctctattatattacatgcttctggaataaatataaacacaatgaaatcctttcttgaaaatttaggaagatgttatacacaatataaataagttgtaagatagtgatttctactagacagttaaggtattaaggactatttgtccttgtattaaatggacccaggctatgcctttctagtgtttttgtatactctgattttttagtggctttccattaaatcctgaaagctcactactaagactcatgacattttttggggggttagaaaaattactatgattcagggctgggcgcggtggctcatgcctgtaatcccagcactttgggaggctgaggcaggcggatcatgaggtcaggagatcgagaccatcctggctaacacggtgaaaacccgtctctactaaaaatacaaaaaattagccaggcgtggtggcgggcgcctgtagtcccagctactcgggaggctgaggcaggagaatggcgtgaacctgggaggtggagcttgcagtgagccgagatagtgccactgcactccagcctgggcgacagagtgagactccgtctaaaaaaaaaaaaaaaaaaagaaattacttactatgattctctctctcaaataaaattctggtgacttttctttaactcaccaaaagtagatacatacatatttctaattcattgtttgaagaaaagccttaagatattttgaaataaaattctacacacattacacagaacttgtagctacatgaggagagcaaggtttttttgttttgttttgttttgtttttgagacggagtctctgtctgttgccaggctggagtgcagtggcgcgatctcggctgactgcaacctctgccccgccgggttcaagcgattctcctgcctcagccttccgagtagctggaagtacagtcgtgcgccaccacacgcagctagttttttatttttatttttatttttagtagagttggggtttcaccatgttggccaggatggtctccatctcctgaccttgtgatccacctgctttggcctcccaaagtgctgggattacaggcgtgagccaccgcgccccagcctgtttttgtttttattttgtaaaacggccttctccacgctgaaactctctctcttttgctctttcatctgtcatctcctccccactcccacaccccacactcctttacccaatcttgccactgcaggacaagagataggatgaaagttggaaaataataatttatggagaaagcctgtgttccttgctttatgaaagtaaattgtagataattaatgttgtgacaagatgattctattttgatgaataaaatcattgaaaagctatcaagccccactgtttctctgctgagagaactttttttcctctctgttctgcattcctattcttggctttcttcccaattagtctctgctaaagagtgataattggggagataggattttcacctaccttgtgaacagtaaaaatacccatttttccaccactgaagctatgtgtattaatattctatgctttcagaaagaaaatcccacactactgtgattcctgcttaaaaaaggaggtaatctaatgcccaagtaaaaacaattttatggtacttttatgagcttctgggaacaatggccatgtgatgttcagttgcgtgtttcatgtctgatgactgagttcacgtacgtcttagaggctaaatttggtttaaaatatcttacatcttctcaaattccttataacaagagcagtaaattaaaattaaatttcgaccttaaatggattgcatgttttccatttgtaatatattcgtatggttcaaaaatctgaaagagtaaatgagtacatagtaagagatttccttcctacatccccatcttcccagctccttttactccccctcccttctgcatgaaaactactgttactagttttttatgtgtccttccagagttttttctgcatatacaaacctaaaataaacatagattcttattctcctactttttacaaaaaatgtagcacattttataaatattttgcctcttgatttttttcttgcttaacataatatagagttatttccatatatacatacatagggacatttcttaatttttttatagctgcatatcatttccttgcactgaagtaccataatatatgtatatttcacaattacctgattcatgtatatttgactagtttcaaatcttttgatattataaacaatactgcaaagaatattatatatgcataattttatacagtaggataatttcccagtattggaattgctaggttagagtacaagtttatgaatgttgatcagcattgtcaaattgcccttgtatagggattgtgcttagttcggctcttaccaggcttatatgagattgttcctttttcctcagccttaccaatagagcatgttgtcagcctttggcattttgccaatgtgataaatacaaaataatacattagcaaatttttaacctgtgcttttcttattatgagtgaagtaacatattttcatatatttgagtgatgttcctctatacatgatttgtatcttttatttttttcaacattcaaatattttattgttgatctttttattatttatttctataggcttcatctaaattgcaccttttcctgtgatataaagtaaaaaatgtttcagaattatatcatttgtattttgactctgagtatcatctttttttctatttttgtttttttgtttgttattttctgaagaattggttgaatttttctagttcatttttcttcgtggcttctggatttttagtcataattagaaaaggctttccccttccaagattataaaggaaatctcctgggattttttgtacttttgtattatctttaatatcacataaatctctgattcatctggaattggcttgtagtaagaagtttattttttctttatatgacttaattattgaattgactatctttttcccactgatgtaagatattacccttattatacactaaattcttctctatgttgagcaatagttttgaattttctgttcaatctctttggtctgtttatttatgtgccagtattcagggactatatgttttaacatctagaatttctaaactacctttaataactgaaattgctaagctgttttcctatttaaaagtttttctgaatattcttttcttcttttttctttataaacttccagattaacttgttttattcaaacagctggtgttttaaaaatagaattttattacattttcaaattaaattgctgtctttatgatctcgaaatttattctcaaaattatgatattactttttcagttgtgtaattccctttgtttcctctaatggtgctttaaatcatcatataaatcttgcacatcaactttatcagctttatctcttggtattctatctttttcatcactgttgttagtgatttctatatgttgattttgaattctattttactcatcttttattgcttgtagttgtttttcagttaattatcttttatcttccaggtgtataatcatagcttctgtagtaaataattcctttgttttcctctttccaaatttgtatagatttaatttggttgtaactcgtctaatcgctttggattgtacctagagatcagctttaaattttatcagtgatcatctttttcttgtttctgacttctgggattctaaaattttgtcataaagcatgataatggtttttggtctcggttggctgtattttattacgttaatgaagtatccatctgtacagtcctagagttgtagctggacctgtgaacaccaccttaagacacgcatttctcagccccgcttgtatttaagccttacttgtatcacctagtgattcatgtgtgcccatgttcttgccattgtaacgtaagtaaaagtgatacttgccatttcttccacatcctttcttttcccttcttgctggcaggaaaccagaagtgatggcaacccagcctcaactatgtaaaggacaacaaggccttcagggatggctgaccatgagatggagggaacctgggtcccagaatcacttcgtggaacagactactcccctgaacaacaacttccgattattacttgagaaagaaaaataaacataattgtttttttttttttttttgagacggagtctcgctctggcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacataattgtttttaaagccattttattgttgagttttttgttacacaaagccctttattaccatgactccacatttatagttgacccttgaacaatggggttagagggttaggggcaccaaaccccagtgctgttgaaaatctgcatataatttttgactcaccaaaaacttaagtactaatagtctacttttgactggaagccatactgataacctaaatagccaatcaacacacatatttcatgtattcatgacacacgtttttcttaaatttttctatatttctagtctgcacagcaaatctccaagcaatttttatgtatatttattttttaaaatctgcataaaagtggatttttggagttcagacccatgttgttcaaggttcaactgtagtccttttttttttaggtgattttttatttaatcaaatgatttatttttttttaatcaagtgatttttttttttggtcaaaaacctttttcatctatggaaattatcttgtgctgtatctctagatatattcatataaattatattaatggttttacaatatttgaccattcttgctttccctggaataagtcacatttcatataacgaattatttgttcaagtgcttctgggaatgtttcaccgatattcatacctaagattcgtcagctgtttttgtttcctgcagtctttataaagttttgatattagtgttactcttttttgtagaggaaagaataattttttaaaatttttccttgttctggggctattttaaaatgctggaattcactgttctttaaaaatgtggtagaattttcctagaaaacttccaaggccagaggtttcagagtattaataattggcacatttctctaattcatttgttgaaatcagattatttagagtttctatatcctttggggtcagttttggtgaattatacattactagaaaattacatatctcatccagattaaatttattttggcatagagctgaataaaatagtctcttttggcttttttatttttctttgtttttgtggctttttaaattcttattttcatgtttgtagtttgttcatatttccttgaatagtttagctgtgcttcatacattaaatatttttcttaaaaaataatttttaaaatgtatttattctattttttccctaactccataaatattaactaccctcttctccttttccattgattttttgttcttttctataaatttcattcagaaactcaatttccttattttctttattcttttaaattttttaataaaaattaaatgctctgagttttcctttgagcagtgctttagctatagctcatgaattcaggtatgatgtttccattaatattatatattcagatatatcagattgcataactctttgaagagggaattgttttggagggggttttaaaattaccatgagaaaatttttatttttctccagttttatcaatttctatatttaatgtatcatattaagagtatgttttcgctgttatttctagaatttgcctatttctgaaattttctttatagcctcatatgttatcaattttaataaatattccataaatccataaatatggattgttgaaaagaagataggtctttttatttctaatataaagtatttttggtatatcaaacatccataacacattaatgatgctactctattctcatagcttgagagaagagaattactctcttctcactagtgtgtttctgtctcttatttcctgtaatttcaggtttgtgaacattttgctattcataacaattttttgtgaattacactctcttgagttatacaatgttgttttttgcatcattttgggcctaaattcttgcttgtctaatatgaaaaataagaccatctacttggattcttttctgttttgccagtatatctttttccacattttaattttaattattgtgaatcagtttgttctagctattcttttaaacagtattgagcttggttttactttctcattcaatctaaatatctttgattttaacaagtaaatttaattgattgatactgatatagcaggtatgtttgttctgagtgctgccatatgttaaattttttgctttcatgtttgctttatgttctttaacagtctttcattatgttgtctgtgtacttccctttgttttaagtatacttctgatatgtgtgaaggtgacatatttattctattggctatctttataatttagttgttaaccttttgtaaactatgtttgtacttctatcagtttttttgatctgctttaatgatattacttgatttccaggaattttagtaaaataatcaacaaacattttcaacttcctaatttcttttcccctccttcgcatttttaaaaattttaccagttctgcttggcagagcacataatattaacattcttttttggtcatcccaaccctcaaatcttttctattatttccccagtcatatttatttggctgaagaccacctactactgtcgtcaagaaagattaaatcatttttgtaagtaaaagctgtttgttgcctttattcctaaaggacaacttgactcaaactttctttttctgaggatcttgtagatggtgctgttaatacatgttttatggtgttaaatgcaactgtagagaaatctgattttcatgcttataagtaatttactgtttttgctggactaccttacatattctttctttaccatttgaagttcaataactgtctgggttgtctacactgggttagtttttccttgcctccagtgtacctttcaatatgtatagtattattttatttcaaagacttttggggagcttatatctttaagttgtctttatgtctctctgtttttcctttttaagtactctgtcttcttctgttaaggctgctatcacaaattatcataatctaagtggcttatgaacaacagaaatttatttcttacagttctggaggctgagaagtctaagatcaaggtactggcagatctgtgtctggtgagggctgcttcctggttcatagattctgtcttttcactgtatcctcacgtaatggaaggagcaaagaaaccttcgggttctcttttatgagggcggtagtcccatgcttaaaggctctgcccacatgacctaatcacctcccaaaggtcccatctcctaataccatcaccttggaagttagggtttaacataggaattttagagggacataaatagcacactccaaatacgtttgttgtatctactttgcctgtcttctgtatccgtcatctagtctctcattcttttcaagtctttattttcattttattttgttctcctttttttaattagcctttatgttccttattctattttctgtagcttttttttatcatttctgtgatttcacgctattatttcttgagctctgacaggttatatttgagcatttcctcttgacttcctgtttcttcttcatgatcttttttttttttttttttttttttttttttgatggagtctcactctgacacccaggctggagtacagtggtgcattctcagcagctcactgcaacctctgcctcccaggttcaagcgattctcctgcctcagcctcccaagtagctgggactataggcacgtgccaccacatccggctaattttttgtatttttagtagagaaggggtttcaccatgttagccatgatggtctcgatctcctgaccttgtaatccacctgcctcggcctcccaaagtgctgggattacaggtgtgagccactgcgcccagcccatgatctttcttttaaaggcagttgcttcatttattttacaaaactaatgacaaaaattttggttagacttttcattctgtcattgaagaaattcttgtgctctttgtctgttggtaagtgttactgctcttttttttcttatagtaaccgcatatcagtgttgttccatctcctttgctaatgctcaatactgaatgaattgggtcttcatgccttaggtatattagcagaggtgtttgtgaggtgggaagatctaggcagtcttctaaacttcacatctgaaaggtgttctcattaggtggttccacagagacagtgtacttgctgctaatatggccccttcttcaatctgtctgtctattatgaatcaatcaatcaatcaatcaatcagtcatctctctgtccatccatccacccatccatccatccatccatccatccatccatccatccatccttctttcttttctgcctctctagtctaaactgtatttaggaggcttcagcagccagccctactcactgccatactccttctaatttttttttttttttttttttttttgagacggagtctcgctttgtcgcccaggatggagtgcagtggtgggatctccactcactgcaggctccacctcccgggttcacgccattctcctgcctcagcctcccgagtagctgggactacaggcgcccaccaccaagcccggctaattttttgtatttttagtgtagacggggtttcactgtgttagtcaggatggtctcgatctcctgacctcgtgatccgccggcctcggcctcccaaagtgctgggattacaggtatgagccaccacgcctggccactccttctaatttttaacacatggtgaggtgttgcatattggtatattctactgttattgtaacttcttttccatggtggtgtatttttgttggtattttctgagaactgttaatggtaagctacttaacctcactcttcacttcattttctccttaatttatttccttttgcttctatcagacctttgccctattgacaggatagttgagtataccaaaaatacaattttagcattgcagggtgccacacatgttgagaaaatatttttgccagtgtctttggaaatttgcccttgaagaaccaactattctctgtttctttttttttttttttttttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggcctttctctgtttctttataatgatttttctgtacaatatcagttgcctttgggagactatgtatgcttggaagtgtgaacattatatctgttctaacttttatgattaaggagtttatttttttcctcatttttttcttttctttgttgcttttgtgtaatacccagcaagtggaaggttatttattctgatgccttgtttgtactgtaatttgaaaactgacattttgggataattttatttattttattaagattttttttgtattggtggtcatgtatgtagtttaaaatgaagtgtggatttttaggctataaaattagccagggtttagaatggtaaggtggataaagcacatttactttttttcctccatttttccttttgaatcctgatgagtattatctagttttcatttttggtaagttctccacattcatggactgctttgttactattctgaccataaaatgcttgaatttagagttctatgtgagaaaagtgatccttgttgtgctgttatgactaagcatattgtataccacagttaggaaataaaaagcactttgcttcctgagataaatcatctatatgcatctatccatgtatctatcaattcatctatctatctgtctatcaccttatctagtactattccctcaaattaaggaaggcttgagctctttcttataagttgctaactctctcattgaaataattcattccctgaattttgcaaaactgacatccataaatttgtgatgacccttgaagatatgattaaaaaatgaagaaactgttctaccatgaataggctaattgtaactttagtagccttgtgatttttttttctctaaatacccgctgtgtccatttgtcaaagatccttgcaaatatttaaattttgcatataaaaaatacctttcaaagaatatttttatgtctgcatttttcttttaccagtgacatttcactgatcatagaaatgaaacccagagttattgctatatttatgaaaggatgaatgtataattgattaaggagatctatttaatataaagcttataattagggtcatgataaagtcttgaattgtaaatatatgttgtatttattgaatagaatgcaattagagaatacaaacctataaaatatgtaatattagaggtggaaacaagacaaagtttctttgacaaaaaggtgcatgtacatagatttaggtcagagattgactaatgcttaaaaataaagaaaaaatgaatcaatttaattgagataaatgatccatgattaggataagagaaagtctagctattcaattcagagttcacttgaatgcatgggctgctgtcaagtttttaataaaagtacagagcagcttcctaacagaggtatgaataataagtttatatgtctctgaaacaatgttaatataattgaatcaaagaaataattaaatgtataatagtcttctatttaaatttgttcttaacagtgcaatttcttatttaaattctgtattatgaatttaattatttttgtcaagattttaaaaaatcattattataaccagttggcaccataattacttttagggaaggaactgtgttgggtgcggggagcaaaacttggtaagtcacttgggattaaaggtgtgggactttgaggatagagcctccgtaacaggataagttattctacatgagaaaatgggaagtgtttattttgaactactatatggattgggattggaggctgaaggcagtcttctaggtatcaaagggcagggaggttttacctgacatatgaattattgtttcatgtaaatatagttgaaagtcatatatatttagaattttaaatacatagtttcaagacagtgcttttaattttttaagaaaatatgtgtcatttattttttccaaagctagtggaagtttctttgtgtcctaatagcaattgcgtgaatgaaatcgacatgaataatacttccagttagattttcataaactgacagatagtttcataaatacccaatatgtaatgatagtcagagggagaagctatattaagtgtgtatttcaggagagattgtcctctggagcatatactagcatcaggcagctgctttatggaaccacccaccaattcccttgggttgttgttattattgtttgttttttgtattttgtttagtttctagggaacataattttctttgtgtttctttttgcatgatgctgaccaagtcatgttcataaatcacatatgttgatatctacagtgctttcattggccttccaactcgagcatggcaaaatatgcttattttccttcagaagcgcatctttgtgttaactaggcattaacaatatgtgcttaatagcaattatcttatttctaaggatctcagagttggtttggcacattgcctcagtgctcttcaaacattatcagagaaggacaacataaacaataagatttacactgtaaaattagcctccacttacaaattcttttatcagccaatccttatcttaataacatatattaccttttattaaagtaaatatgtccctcagctctagcttttttctctgtatttttatgtacatttatggagttttactgaaatatttagaagactactgtctaaatacggttctaatttttaaaatgcataatctttagggtaaagtcttggagagtggcaagtttaatcaaacagtaacgctatcagagataaagatcataactcgcattaaattctataatttaaaataaactatgtctggtatgtattcagaaaatgtcagagctagaacatttagttcagtctctatttcatgggttaaagaaaagaaagcttagaacagtgaaaatacttcctcaaggtaatacttacagttcatggctgaagtggtaataaaagtcacaaccaactttttcctctctgctttcttttctttctgttctgtcattttaagtttcttaaaggaaaagcttagagaaaattaagtattgatgatagagcagatacaggattttcaccgggtgcagtggcttacgcctgtaatcctagcacactgggaggctgaggcaggtggatcacttgaggtcaggagtttgagacaagcctggccaatatggtgaaaccctgtgtctactaaaaaaacaaaaatttgctgagtgtgatggtgcacacctgtaatccctgctactcgggaggctgagccaggagaatcacttgaacccaggaggtggtggctgcagtgagccaagatggcactactgcactccagcctgggcgacagaatgagactccatctcgacattaaaaaaaaaaaaaaaaagaaaaacaaaaaaaggattgtgttaacatgggggcctgggtgagaagagaaaatttatttataggaggacatgtaggaagggcactgaagattactgtttaccattttgaattgtccctgctccagtcttacaaagtgggacatgcattgtgtttcttgggcatactcacttccctaagaataagctgtatcatccaatgctatttgcacagaactcacggctttatatttactgtcctaaaataagtgatttacaatcttttaaactttaaaacagtaaatttgattttcagcgatgcctttttttttgtcattttaaggccccctccaaagtgttgtaacctagctgaatgaaaaataagtggcatttttgttgttattgttggtgatgatacttttcatggcaatctttgagatacctaggaatattccaagtttttgaaaaatcatggttgggaattaccactctggaaacagattgccatggttactgtgttaatgctgtgattaatgcgtcttttagtcttgtatgtgtgtgtagatgtagacataattctatattctagtttggttaacatgtttgatctttttctatcagtcagagacataaaaatgtcttgactctcttaaaaacaagactgttcccattttttaacctaatggatatttgttgctgaggatcatttttttgtaaggagtgaaatacccagaaaactaaagtggtctagaagataactgctagttctacatttttttttttgtctgaagttgtgtttgaatttacttcctttcatcacttagtattaaaagaacagtgtgtcaattatagataagaattctacatcccctgtctttccctaagtacctgcttcgaaaaatgggtgcaactagactcagtagctagatgtggtatgtggaatgtggattcgttcgtatcaggcatgcttcttataggaatcctttaatgcactcagtcacccagagcagtcaaaggcctaagctgcttcatactttatagcagggcacagtcacttccataaatactgtgcactcccaagtaaatccagaatgtttgcaacaggatttgtgtaccatccccaattctctgttttcttcaataaagtctttgtacacaattgtttgattgtttttatctcttgatactcacaaataatgccactggagaaataaacctaagacatatccaactggatcactttatatacagagatataacatttcaacaacagaagcctttcttgttgaggggatgcacatttggaatactctcaaatgattattcgaaatcaagaaaaagagccaatgagaaacagcaaaacacaaatatctctaataaggaaaaatatttctgcaatgagatttttcttagatatatatgtgatgattaagagcatttgtttatattgtaggttcttgtcctaaacttacaatagtaagtgtagacaacactaattgttatggtaaaaggtgctacatgtgtgtatgtatgtatatgtgtatgtatatgtatacatatattatttggatattccagtcagtggtacttactgcccttggttaatgcataattgtcttgagaaaatgattatatgtatcagtgtgatctggctaaaacaactctctccaactgatcacctgattttgtttcatttccccgggtaatctggtaggtggccatttcttttctttctagtctatgttccctcctaaagataaaacttggtcaaacatctatttatggtaacctgtctttaagatagtttcaggcataccttcttcctttaatctcatttggttgatatgttagatcctttcctatcagccagagaaataaaaatgtcttcagtgtcttaaacaaaattgtttacattctttaattaaatggtcattttaaggagagaaatgctcagaaaattaaactgagtatagaaggtaactgctaattctacatttcttttctgaaattgtgtcttcatttgttttttaaaaatcatttagaagctgtgtagcccacagagaagttctcaagtttgtggaaaagaaataattaagtcccgaagttaggggtagaagagaatggagctttgttggtcaattctgacatcttagaacacctcagtaatgtggttctttgaaagcatcaaatcgctgcggttactttagaaaggtcatttttagaatgcttatactacttttcccccattttgaaggtcaactggggtttattttaagttagtattgatgtaaaagatggcacaccctcttctggggcataaatgcttgaggatgagccatagtcatgcatgacatgtgtcaagataagaaatggaaatttatctgcagagactaccatatgatgtatgtgtaaattttcagtccctgggattatgatttttttttttagtgaagacaaatgttttttgttagttagatcctgatttttggcatgatttagtaggagaaagaaggttttagtttagacatagcttttcttacatcttgtgtaaaattgtcagttatagggagggtaaacactgcactctggaaaggccttctggaatgtccttatttctgtgtgagtgtgatggaaaaaaataacttttaaaaaaatacatgtttaatgaaagatatttccaggttattccttctggattttaatttaacgcttgtttgtatctctatgatagcatgtatgaaaatgtattttaatgatttaattatctccccatattagatgatcttgctatctttatcatatgccctgtttatttttctattcctggtgataggtggagtgactgatacattgcaggtacataatatacatttttgagtagatatgtgtatgattaattgacattttgcaagcctttttttccaacttttaagttctggggtacatgtgcaggatgtgcaggtttgttacatacgtaaacatgtgtcacggtagattgctgcacagatcatcccatcacctaggtgttaagcccagcatccattagctattcttcctgatgctctccctcccacccctcaacagtgtgtgttgttttgacagaccccagtatgtgttgttcccaccacgtgtccatgtgttctcatcattcatctcccacttatgagtgagaacatgcaatatttggttttctgttcctgcattaggcaaaccgtttttttgtttgtttgtttgtttttgtttttgtttttaaagaaaaaagaaagacatgctatgaaatggccttggacctaattcaagaaacgaaagaaagtcagagatcaaggaagaaaggaacaatgcagagtttatggaagttagatgttaagatgacagctgagtatgcttcttttctcctcacccttgtttagccaggtgcttacttgacaatttgtaaattaaattattccttgaacaatattttgcacaggagtaaaggaatgcttcatggataaacagaggcaatacctggagctaatctttgtggataaatgtgtttattttgattcctgaagctgggatgcagaactgatagagggaagccagggggttttctctgctccaccaaataaatcacatatgactagaaattgcaaccagacagcaatctgtgaagcaagtgataggagctccaccgtctggtgcctgctgtggatgtctggcacccattggtaccagatttggtgtaagtggggcttctgtttaggaaactttgccaatttttttttcttgaaaagtggattttggctttgtttctgcattcttatatgggaataaaaaaatctcataattgcaaatgtgtttattatgccccaaacattagatctaggctattctttccataggatattgtaatcctgtgtgggtacatttgctgctgcatttgacacagtaaagttgtattaatgtttttcattctgctatcttttagaactaagataggcataattcctaatttatctgtgctcccccttatgcatacatttaggtagtcaaaccttgagagtttctatagaatatttttaaaacttacctttggtctgtcttatccttggaaatgttttcacgtttgagagcatcacctcctatcagatcattctgttccttgaccctctccctctgacaaatttcacatctttcttcgcaggaaaaaagaaactaaggctatatcatggctttcttcactcctcttcattctgatatgaacatttgaagcaagcattgatttttttcttccttcttcttacttttgccagaacccatgatgctgtttattctggtggggtgtgtgtgaaacgcatgttgcagttccatctctcttgaccttttctttgtttgctatgtatattgcatctcctcagttgtccaggttatcgcaagaaattgtgctggatttctactcgctcaccttctatttcttactaaatattccttgttgtatcataatccctctcaccagaattcctcctgtgtgaactcatagattacaatctacattgctgcaagagactaccaaattttccatctttctcaggtttctgcaccttcactcactcttatatctttccaaactttcctttccatctttcttaatgtcaaacctgattagtcattctcctgcttaaaatcttccaccgagttctcagggctttcaggttgaagttcaagctcattagtgtgacatacaaggctcttaggacctggtggtctcagcccctggctacttccctaaaacactgcccactcagaccagatctaactagttttagttccctatatcatggtatactactgcgattttccatgtgcgcttactttactcccaggtctctctatcctcttcctcttcatgtaactaatttcttcctggctctttgacactgggcatcagtgtcatgtccccagtgtctaatgtgatgtctttcatctgttctcttataggcttggatgcatctccttcctgtcatcttactagtattattgttcactgtccttccacggtggcacagagtccccagggtatatcatagtattgtttgcaaaggtctactaagagtaaatgagtaaatgaatctaataattttttattgctttaagtgctctgtattttaattcactgcctatcaagccttgctctctttgaattatatttatgtctaaatgttcatgatagcatcagattgaattaattgtagccttatatattgactctcaaacatgaccaagactgttattgttgactctatattcagacaaataaccagacacatagagtaaaagagttaacccatagtctgtatgacctaatgaaaagagcttagacaagaaccaaggagcaacagtctcaaatgtcagatgcctttgccatattactcccatttctttttttatagttaaaaatgttaaattttaaaggttaatgtgatgctgctaagccctctgtagggtgattgatcagcttaaatgtaaactattttggtgaccatgatatataaagtcatagtgttgaaaaaattcaacaatagttagaatcattttaagaaaacaacattgatatatgaaaatattcacaattgagaaatcttatattgatgaacttagagattatacattttggtcttgaggcagaactcatcttagtaaaactgcttaagaacttaatcttgatcttataaaataaataaagatggtattttgtattttaaactattgagtatgatttcttgctgggatctatcactatgaaaagtgattattggtttagagtggtgttctcgttattttgggttttgaaggagcacagttcatcctgttggtctgtgttaaccaggggtaggtaaagaggacagaggacacctagcaatggctcaggtattatcagtgagcagggtgagaaaatccttgtgtaccaagaggaattttgtcatggatttgcagaactttcaaaaacaagaaacattatttccacttttcgtgtgattcctctcactttttaacctcttttctcttttccttcttttcgagatggagtcttattatgttgtccaggctggagtatattggctattcacaggcatgatcattacacgctacagcctctgaactcctggctcaagtcatcttcccatctcagtcttgagtaactgggactatagatgtgtgctgtggtgcctggcagagcctcttctttaactgtaatagacctgcttatcatgcatgaaatgatctacaaacacaaagtaccctatcatcattatctctttggagtactatgtcctttaaatgtattttcttactgtaactaactacctaggctggaggtcctatctctaatttagaaatgaagaaagtgagacctacttggattgagtgagcattcgaagtacattcagaagtggaaattatttttaaaagttaaatggcttctagaggtcatgtagtctcttttgtcatatagtggagaaaacagagaagttcaagatttccccaaacgttcttagttactggcaaacaggagctaaatgtcattcttcctggattttagtcagtatttgcttggtcacttttcttagtagagctttttcttctccttgcattcataaacacttaataaaagtgaattgataatgatcatatatattatataattaggtaatattagccgggcatggtggttcatgactgtcataccagtttcatatattagaagaaaagtacaaattgtgtagctactcaagtgcaaaatgtagagagaaaacctagagaagacatgaaactctctccttgactaatatcttcaggctggggatactatgaacaatggtgtgttcagaaagaatgaacaaaattgctgtagtaactcaatttcagaagagtttgaccctgtcagaatcatctactgtatttgcatgagaaatatgaaaggagtccaagggaaagatgatgtgttcagtgttcttttccactgcattggagcacctgaggagctgaagagagaaacttgtgtttcttctttgagtggcaagtgtgttagttaatatcatcaggcagaacatgctttccaagagtttagtttgctccttcacaaactaaaatactctgaagtgcctgattttatgcaaattacttttggttgttgtattgagaaatgaaaggatgccaacatttttttttataaaccaaatactaattagcattaccaaatttatctgttgagatacaccacttatttgtaagagaagctctttgacaaaatgaaagaatatgaataaattcttcacactggctatatgagaccttggaatgtcattttcttttttttctgtagaatttgtgtaataccctccactttgttggactgaatgagatgcatacaaaacaaccttgtaaattacagcattctaggtcagaggctagaaatattttctgtaaaaggcaagagagaaatattttatgcttttgtgaaccataggtctctgttgcatctactcaactctgccattgtagtgtgaaagcatccatagatagtacataaacaaatgagggctgctctgttccaataaaactttatttatagatacagaaatttgaatttcatgtaatcttcacctattgtgaaatgttatttttctcttgatttttgtaaccatttcaaaatataaaaaatgactcttagcccacaggctgtataaaaacatgtagatttggtccaaggtctgcaattcactagcctttctccaggtgactgcctcactatgaaacagttccaagtataaagggattaggatatgatgctgatgttgggattgcatttactgagctatctaggtgattgactccaggctctctctctgatactgagaacatgccttggcatatgttcccagctaacgtttgagaaaactcattttcggaggaataattttctgttgtttgttgctgggagttgggcagaatatctcaggtagtggaaggaggatactgcaccacacaactcatagaactgaattgatacagatagatgtcagcatttctgtgcaaaaacaaatgtttcaaagttttgaggtctcagcacttttccaggcacagcattctggatcttggcacacagatgactctcagtttgaatagaaaatgctcacctttctttttgctagttttattccagagccaatctctttataataaagaaagcaactgaaaatggaaaactcactgagcttaaagcagccaaaggaaaaatatgtgctcattttaagttttttcttttgcaactcttggccaaataggtttatttttaaatacttttcacaatttacaaatgtttgccttaggactttgtgtaatggcattggttttatacagctattacagttagggtgaagagattttcttcacagagatggttttggaaaatgtctcatcacacaagtggtaagtgtagtcgctgtaattgtattgaagaaaagaaatgactaatgggaatcacaaaattgtgaaattgatgatcatttctgtttttattgcctttattttaaacataatagtgacaaagtctgaaacaatatttggagattgctacatatttaaatatttaatgcaacaagcatcccactttattataggagatagaacatcgactgtgcctaacctaaattacttttccagggggttttagtggattattttcctattaaaaaaaggggaaaaaagaaaagaacagtctggtacaaagtataggtgacggcttcagctttgtaattacctattaattgatatctgtatataagtataacaaataaagttttaaatactgaaaatgagatgagagatactaaaggaaacaatttcctgagaagtattaggttagactgtacaaatgtaaaaaacatgtcaacaacctggcagcaagtagtcttgagaccttgaagttcaatgagagcagatgaattgtctgctcttttaatagtaataaaaactatctaaggcaaaattttggcatgtaacttaagaaacttaaaaagtttctcatgctttaagacactttgattttattagatctagaatgaggtctgggaatgtatatttttataaagctccactggtgacctgggtcaagttttgcaatacagaatttgaggcagataatattatgtaggaggtaggagatttattggggagtgctagaagtaccaataccagtgggggagtgaaaaaagcatgtctgtagagcagaagaagctggactgcagagcagttgcagtagaatcccatctgatcctaaggagccctggagctggcattccaggccctggagagttgtcctggaatgaggcaaggaggagggtttgtacccttgcattcatcagtcatgggatacaggatgccccagggagtgggtgaaaacttgagggagatagctctttccaacagagggtagtgtccagagaaggtctggttatgaggtgtcagaagccaacacttgcaatcattggacgaatttcagtcctgaagttgtttctaggcagcacaccagtgtgtccattacaacaggctattcttatgattgaaaaacgattgtctaaggggttgttgggaagaagtacttggactggagggtaggcaaggagtatttatctgtttcttaaacatgtacggagtgcctactatgtataggtactagagacataaacatgaagagataagttccctacatttaaggagcttaccatctagtgggactcagatatgtaaataaataattaaaacataattgtcaaaacaggagggtatgtggtatgtgcatgtttccaggttttaaaaaagctttacttcacaaacaaaaatgttctgttcattctgcttattttgatttgatagattacagctcgcagagctaatattctcttaatgtaagtttcttccccttcacagatgtttttccatctcctctaatttctcatcgttctgtgatgagacaaccagagtctttaaaaaataaatactttgcttttctatgattaaatggtttgatgaaaattaagccataagcataaagtgctaaatagaataaacccctggcacataaaatgggtaggtcctgatatcctctttcaattcttcaaatgtataggtagatactgataccctgtctcaactgtagtcaattacactatatattttcctctataaaatgtatcactggccacgttcagtagccctccattactgaatggggcaattattcaagaatgccccagtgaatgcctgaaactgcacctggtaccaagtcctacatatattgtcttttttttatatgtacatacctatgataaagtttaatttataaattaggcacagtaggagattaacagcaataacaaatacaatagtaaaacaattgtaacagtataccaacatcactgctcttgtacttcgaggccatcatgaaggaaaataaaggtgatttgtacaagagcactaggatattgtgataacgcagacatctcctagacaggatctactggacaaagggatgattcacgtcccgggtaggagggggcaggacagagcgggacagtgggagacttcatcttgccacatagaatagtggataatttaaaaattaggaattgtttacttctgaaattttccacataatagtttcaaaccaagggtaactgaaaccatgagaagtgaaactgcagatatgggaagactcctatagaaaatatttgggctgggcatggtggctcatgcctgtaatcccagcactttgggaggctgaggtgggtggatcatctgaggtcaggagtttgagaccagcctggccaacatggtgaaaccccgtctctactaaaaatacaaaaattggctgggtgtggtggtgcaaacctgtagtcccagctatttgggaagctgaggcaggataatcgcttgaaccccggaggcagaggttgcagtgagctgagatctcgcaagtaattggttatttactacataaaaatgttacgtagtattcatatttatgtttgattgcatcacttttttttaaacttttggctcaaatattggtagttttcaaggaacttttctgcagcattatatgaatatgatgacaagtagaaaaaccaaaagggtgcatcaatgtatgaaagctggtgtgttaaattgttatcatcattaacaattcactgctgcatgctaaattcatagctcacacaattcaatttatgccttataaaattacaaactattacaagtcatggactttaaggttgctcaccaagttatcaagaaggtcaaaggtaaatgcaactgtactattctatggtaatttttcacaaatcccattgattcttgtttatgatactatttcataaaactcagggtcatataataatgttctgtttcaaaacatgttggtgtatttcaaggtctcagaaaaggtattgaaattttttggtgagccaaagagaacaggaaagatgatgttttgtctgtaaattccatgttgactctgagttagaagagactctaagggtcatctggttctgggctgttagttttgaggtaataacgttttcatttacaaaaagaacattggtaaagtaataaaagcttatttttgtatatatacttatttacgcacagattatacatgggaaaaatggtgcccaggcagtttgctttcagtgatatatgttaggtgaaggtcaggaataatattgacataagtaaatattggaatagaaggcaagacttggaggtgggatttaaacaaataaacaaagttttttttttttttcctttttatgctactttgcaggaaggtcatgtcaaaattaaaatagattctgctttctaccttggcaagtaacatgtattatgcccactcacatgtaggtcttatctgctttggcaaatacttacagaagaaagtgtaatttggaaagagaagaacataatgatattagacaaaatagggtcacaaaaatttacaattggaaaatgatttgtaagttaataaaattacctagagccagattctactgtctaaatataccactgaatgtaaacaagcttttgctgagctagtatagacaggtttgaaaaacttggttttctccagtactcactcttatcaaggaggaaaaaggcccagaaaaaaaattctgaagagtatttttgtatcatttacttatgccccatctttttctcaaatatatttaagacagtttatcagaatacatactatgtaagaaaataacataaataaggaaatcagggcaaacagaatgtaaggttttgaaaatgaaaaaggatctggggaatctgaggataaagttaacacaaaaaatgcttgaggatctgttcatctgctgaatgacggttacaaatctgtaaatattctgatagccaactctaagagaaaaacacagttatttcaatgtttatagttatcctggaggagcccaattctttctctaagtgggaccagagaaaaatttcccctttgtcctaagaaagaattcctacggagtatagggtaatcaagaactcatgaagctgtgtgtcctgtaatgccccttaagtagttagatgattgcaggccaagagcaatacagtcaaactgattttaccaggaagaaaaagcagtcagtccaaaaacaacattcttgtggtttgattaatccaaaattggttagattcaggaatggaaatctgcatagactttaggcaaacctcaataattatttctgtaaccaagattctgataattgttgaggaagtagtgaattcaagcttatgctctctgtacttcctgacaaatccttggagtgcatcactgctatgttgttagtgcgtgtggacccatatgcctttgatatttgccaggctggggatataaatgacatataaagatgttctaatgagggctactcactctcttttctctctcacagacacattcactcatgcccatgtatatacagataatcatatagacatatatacacacacataactattgaataatttgttgtttaaaaaatatgtttcaaattaatggggaaagatagattggggaacagatgggcgtcagacaatttgctatcaatttggctagaaatcaagttagattcctatcttacaagatatgcaaaacatagaaggattataaagtcaaattaaaaaacaaagtattagaagaatatatggagcatttttatactcttgcagtagggaaagatgctcagagcaaacatgaaatccagatcccataaaataaaaatacgaagtacttaggcaaaaaccaagaagaaataacaaactttggtaagacacaaatgatagtaaatgtataaaagtcaatataagtaaaattaaaagagaagtgataaacttggaacatgtattctaaacatacaacatgaagaagcttagtatctatgatttttaaagaatgtcaagatattaatatacaggaaaaacagcagaatagaaaaatgagtaaagaacatagtttttttctttttgaattaattgaatttgaaacagcggtttttctccttcgaggagtaggacttttcacaaagcttcagtggattgttctaaatactggaaatgatatggagaagcacgtctcatctttctggaaagcgatttggcaatgtatatcaaaccttaacattacaaatgagcagacccaacaaatgttcatataaaactcacacctaaaaatataccagacatgaaggcaaagctatatatacaaagggtgtttacagaaatattattcttatgtcaagtgtggaaaatactaaccgaagtccacatgtccaactgaagaggaattagggtttaatgatttaagaagatatcatgaaactattaaaattatgtttaatgttaattatataggaaaatccttgaggtaaagttttaaaagtaggatacaaaattatgtcatacacacacacacacacacacacacacacattttacaaaaaccaaaatatatgtatgatatgtattgttttacacatggagagatataagtatacacattataaatacaaattaatacttttggtcatacaggatgtctctgttttttgaaatacatttttcaatagttttgacatttttagccataagtatatatcaatagtgttatttgaaaaatatttaaacagaacataactcagttaatatatatgtactaaataaatttataatttttaagggcagaaaagcataaatatttcaggaaattctgaactaaaacacagttgaaaacttctaagactctatatcaatatgcaattgcaatgttaaataaaataaagatgttagcaaatagcacaatagtagttggcatattggaactagaatttcatcacgttatttgcaagacatctaatatgagtcatttgacccaatattttccttgtcttactctgggatgatgatacctctgtcatggggttgctgtgaagagtcagtaagatgtaatcaaccagcgaatgttaggtgctcagtacattttaattcttcatcctctttctctttttcctctcagcacagataccagatgtaaaaatgttatttatttttttcctagcactagtaaggagttgaaagtttttttccataaaaacagtgcccagttcttggtgatgacagcagggagacctttctcactcctcttcagggtgaaggtcagtgggttcgttccagttcattgactggttgttcacagctgacgttatcacgattagacaatgctttgccttaccaattatttaacgtaactgtgcttctgtctttgctcataaaaactctggtttggatacttcactcattgaaagcagcagaggcaaatcatcaggtatatatacagcttcaatgcctaagatattgggctacttttgctagttagcctgtggtccagtagccgcccccacaccccaccatctatttttggaacgtatacaaatggagaaagatacattaggttcctccattttaatctagttatttttttaaaaaaattataagtatgaattttaggctgtaagtgtaattttgttagatggatagattgtgtagcattaaagtcaggacttttagggtagttaccatccaaataacatatattggccagagacagtgtctcctgcctagaatcccagcactttgggaagttgaggcaggtagattacttgaggtcaggagttcaaaaccagcctggctggtcaacatggtgaaactccatctctactaaaaatacaaaaattagccgggcatggtgatgcgcccctgtaatctcagctactcaggaggctgaggcaggagaattgcttgaacccaggaggcagaggttgcagtgagccgtgattgcaccaggccactgcactcaagcctgggtgtaagagtgagactctgtctcaaaaaacaaaaaacaagtatattgtgcccattaaataatttctcattatttattcctctcctatgtccccacccttctgagtttctattgtctatctttttatactctgtgtccatgtgtatgcattatttagctcccacttgtaaatgagaacatgcagcatttatgtttctgtgactgacttgtttcaattaagacaatggcctccagtttcatccatgttgctgcaaaagacatgactttattctgtttttttttttttatggctgaatagcattccattgtgtacctattacatttttttttcccagtcatgcactgatggacacttaggttgattccatattctttgctgttgtgagtagtgctgtgttaagtatacaggtgcaggtatctttttgatataaagatttctcttcctttgggaaaacacccagtagtgagagtgcaggatcaaatggtagttctttaaactctctaagaatctttacaaaatcctgccactgtaggtataaaacaatatgtggtctcacttagaataaaatggagacattttaagaatgtgttgtttgaatcctggccatgttctttcccagaggctacagtttggtgtagttcactggatgtgcctgtggacactgaacttgactggctattggatttctgactcctggaagattttgaggagttgcagctcttgttctctttcatctcccacccatctccagaaaagtccaggttacacctgtggaagggttaccagccagaggacagagtgtgaaggcttgcctggtaatggcaaacccagttgccatccacatgtcatactttgcaccatgtccctgatttgtatgggttctgtacatgtcacagtttctaagagtgaacctctctgcccccccgcccacatgactctgctgtcagctttccaaacaatgagaggacagctcctttgaaagatgtaagttttccattccgaaagatataaatttcctggtcctgcagaggctagaaatacctcttgtttgggtcactggactcgggctaggtgatctgcaagatcttacacaatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctacaaaaaattaaaaaaaagccaggcatggtggcgcgtacctatagccctagctgcctggaaggctgaggcaggaagatcgcttgagcccaggagttcaaggctgtagtggaccatgatcatgccactgcactccagcctgggtgacagagtaagaccttttcttacaaaaataaagaaatagagtacagattgtaactggcaacagtgagtctgtctcctccctttcctcgggcatcagagtcaaaagaatgacaataacatttgctataattattttaagtttttttaaatgatatggcccacatatagaaaataattatcatgttgtcttctaaaggatttgattactagaattagataactgatttctttctttcaaaaagtggaagcttttttttgtttgtttgtttttggttaactgcattttaaattttaggaacaagtagattcttcttcagtcttaaacttcagcacctgctaaaaataaggattacgtattaaacattatattttcccccagttttctctggatgttactgcaaaaatttactcactctcatttggatcacaggggctgataaatgtgtgtgtttccagatgctgcaccaggactgaacctgtggagtaggaaatgattctaccttagatacacataccctcctctcctgtttttttattctaagtctccctagcctcttaggtttttgtttgtattaccctccctctttcctgcttccagccatccctattatgactctaagggtcccatgaaagattaggtcatctgtgatgctgtcagaggcctggagaagtcctccacctatgtgtgcgtcatggacacctggacacaggctaaaagcttcttgagcaacttggtaatggccttctgaaaaaaaatgcgctcagccaatgtattactaattctactgggggaatttccaagtcaatttctggggactgagagtggtacagaaggatgagggtgtttaggtacactttaaattcacagtgtatgatgtgccctgaccacccccatcctccacacacccactacttactcctaaaacaattttttctaagccaaaagtggtttatgacaaattgtatgtttgcagatttggagtctaaagaggagtagatttatttaagggccatatttagtgttagtaaaagctacacttactatgctaattgcaacttaaattagagctttacctttatcaccaaaaaaaaccccactgtcttcccttgatgttaaattgtaggaatttaaagtaatttaaatttctattttttctacatttccgctttttgtatctgtacaatatgattatacatgtgaatggttaacaaaaactgtatactttagtctttaagtggaacctcagtgcaatattttgtaggcattaaaaatgataagcactttcatcagactattagttttcattttgttgactttgtttgtttagttctttgtggtataccctgtagttataatgaaatgatgtaaatctatatatttgccaacacatagatgtatttctttttaacttaactttttagcattatgcaggaactgctgctcactcgctaattatcccacagcctcgcaagatggcatctcctgttttctagcagatcaggatcaaaactttggaatcatttctctttctcttacacctcatatcccatccataagaaattctctgcatgtatctagaacttggcacttcttaccactttaactgctaccatccgtcatcttttgcctggattattaaaataacctcacatctgtccttttcttgccattttatcctttattcattagccagaatgagccttctaagactgtagtcaaaagtcatacagctcctttactcaaaccctccatgaacttctgacctcattcagtgtaaattcccaaggtccttaccatgaccttcaatgccctttatcatctggtctattaatgccacctgacctctttttctaccaccgccctcaggtcactctgcttcagacataggggcatcactgatgtttcagaagcactgcagaacccttgcactaactgcttccagtgctaagaatgagcttactttgtataagcatggcttaattccttactttctttggtttctgtccacatgccactttctcagtgaggccttcgctgacttccctgcatgagctagaatccactctgcacctggcagtctggacattcttaccttggcttatcctctattatcctagagatgtctgtcttcatccccaacacctagaacagtgacggacacatgatagctacctcatgattatatttgaatgaataaatctttaattatccataattgggtagtagacccaatcttgcacaggcagccaagaaacaaaaccaagaaaaaaaaacttagtttctatgtagacctgccactaactagacatacttccttttgcaggtgtttaacatctctgagtctcaaatgtctcaagtattaaaatacaatagattgaactagacaatttcaaaagttctgcttgctctaataaaatactttacacgaagtaaacacaattccactgatgtttgttcaatattttctatggcaaggccattcctcattatatataactcaagtagataagtagcagttgttatttgtcatatgtatgtatgtacgtacacacacatgcacacacaattcaccctctcccacaatatcactgtgttacacaatcctcagtcctattacctctgagacccattgtaaataaaatgtaaaatctttagagcatgttggacaaatacatggttttggttctgcctctttccagtcgcagacatcactgtgagattatagaactctttccatctaggccaagactgggtctaagaattcttctcagacttctaggaaagatatcaaacttattagagttgaaactagagatgtaacatagattttattccaggttttgggtatctgagagcctagaagtggtgtgagataaagaatttgatacaccttctccagtctttttgcttggttttccttcaattcatccttccaaactcattgtagataccacttctcctaggatttttccccaaatccaagactgtgttatgtggcccttgttatctgattacctagggccctggtctcaattacagaattattatgttgtaatttctttttaattttaacttgactgcatcatctacctgactgtgttctctagaggttcagaccaagaattgcgttttgaagactgagagctgggcctgacacttactagggacacaataaatgttgacttattgaacagataaatgaatgaatgaatgatgcccaggatagaatatttggtactgctgtcctgtctagcacatttctccaaggtaaaattatctcccacatatgacaaaaatctacctttctcttggttaaatcccttagtaagctgcctatcagagaatttgagggttaactcattcttttagaataatgtaaataacttggatgggagcaggctgtatgctttaggtcaattagaccaccttctcatgcctgagggaaattgtcccttaaggtctgttctatggcacctagtcccctaagatttgacaagaaagcgttccacagttcaatatatttggaaaacattgctcgctggcctttccccttgaaatctggccatggacattagcttattagagattctgagtcatctagtaaagaattctgtttaatttttttatagctagaatttttcatttcttttgaacttaaggataatattcaacattatatatattaacattctactggactaatgctttaggaaacagagttttacacacatagaggccatttaatagctttaaataacagtgtagcagccatatggcagtgagcagattggatttggaaaggggtaaaaccagtagggaggatgttgcagaaatctagatggaagaggatgaggcctataaccaaagtcctcatagcggccacggagaaatgaaaacgtttatgcaagaaactgatctcgttactgaaaagtcttttgcaagagtaactaaggtggttagagaacaggaggttggtactgtagtgctttccctcttctgcctttcaaaggtaagagcttgacttcgtttttaagccagcaggggttcttacatagctgagtgtctatcactacttaatgcatgtataatgccctgctgtactgatattcatgataaaaatcaaggtatttacagtcaattataatttcttattctcaaagcatacattgattttcttaaactaggcttttctgaactgggtatgataatacacattattatcataccattattaggcctctctttccaggtctttcagtgaaatctgtgtgtgtgtatgtatgcatttcctaaggctgttggtgcaaagaaacacaaactgggtggcttaaaaacaacagaaaccaaaatcaaggtgttggcagggccatgctccctgtggggttctggcagatccttccttgcctctccctgttttctggccatgtctgtcaatccttggtgtttgctggcttgtagctgcaatgcttcagtctccacctctgtcattcgatggtgtctccctgtatgtctctgtctctctctgtgtacacattttcatctttttgtaagtacaccagccaaattggattaagggtctaacctactccattatgaattcatcttaactaattacatctgccacaaatttatttccaaataaggtcacattctgaggcaccgggggttaggactttaacacacctcctttgggggcccaattcaaccaataactacatctgtgtgtgtgtggtgtgcacgtatgtgtatgtgtttgtaagtgcacacgtaagatgcaccaacatagatgcaaagacgtttgtcttcccaaatttactagtagtatttctggctctactcccatgaaattacctttaccctttctctttgaaggatggacaaagccaggtctgataaagcgttagaatttgtcatggctggtcttcacgcggcaaaccaattatgtgaccacccaggccttttcatcatgcttggtacattcatggaatgttatctcacactggggttggtaatgcaatactaattctaaaaggctattctgattaatgtattcatcttggtttagcattttttatattgtttatttcagctctcctttcccttttgtgatctaaatatattttctttcaggttattttgctaagtggttccgagctaattttattacttttttgatggtaagggtctaggcagagtagcctttctgaaaggcaagctttaccgacttctccaggttcataaatattaataatgtgtaactacgactctgtgtgctaaaacattgttgtggagattgtacaaggaaggcattttatgatttcatggagacatggagtagcaagaaaatggagcaatgacatttggggggagcatgacatctaaatgttaatattgtgtactgcttactgagaatgagaatttctcttcttttgatgctcgtgttgtcagttgcacgagagtgttcttcaatttgtactttacttcttctagctattttttttctttataaaactgctagaaaagaagccagctagtattttgaataaaagagttgggattgtataaggcaatgtttttactcagctttcctcgaccttttgatgaaaattccagttcaaaataaaaagacacaggcactaccctctgagagagtctgtgtgaccaggctatcattcttaagaaacggattgaaacttcttagtacatctcataaaaaatttagttagctataaatgttttaggctgttgcagctgatatcatttgccttgtgggaaaaaaaaatgaggctgttttatgttaagtgttttgttttctcttctctctattctttttttatatgtattaggcaatgcaaagacttttactaccattgttatgatagtatttaaataagcagaccaaacccatgcatgggactgaagagtaaagtcaagaaatatttgagatgcctcttttaaattaaaggtatattcttcattgctaattttgagttcaattttttactgtatattaaaatgttaatttcaatttcatctatagcagatggtatcctgcttttattttctaaagggattcttcaagtaagccctcagttgtcttgcattatgagtaattagagaaataccttggttggtcctcagggcagagctaaaaatagagttcagtgatttttttctgtaattcttactatttttaaatagaagaaaatgataggcaagaaagaaaaggccatacttaaccaaaatgtccatgacttctttcattactaacaaaaaattgccaagcttgacagtttgcaaataactctcccttctccatgaaggtaacttggaattcgatgtgtgtgtatgtacctgtgtgagtgcatgtgtgtgtgtgtgagagagagagagagagagagggaccacaaagtctctgatgttaacaaatacaagaggaagagcagtagatgagggcagaggtgtggtaagcaattgatctggcaaaatcttgaaagttaagacaagaactctgggtgttactctgagatgggaagtgtttcgactcagcaatcccataatgggtatatattcaaaagaaaacaaatcgttttaccaaaaagatacatgcacttgcatgttcatcacagcactattcacagtagcaaagacatggaaatcagcctagggcccaccaacagtagactggataaagaaaatgtggtacatatgcaccatggaatactacatagccatacaaagaatgaaataatgccctttgcagcaacatggatgtagctggaggccattattctaagcaaattaacacaagaacagaaaaccaaatatcgcatgttctcacttacaagtgggagccaaacactggctattcatggacatatagatggcaacaagagactctggggacccttaggggcaggagggaacagggggagggttgaaaacctacctatgaagtatatgttcagtaccttggtgccaggatcatttgtaccccaaagctcagtatagtgcaatatacccaggtaccaaatctgcacatgtaccccctgaatctaaaataaaagttgaaagtaaataaatagataaataaatgcattaacttttttcatgaaaactaacaacaaaaaacctgagaagacaggccgcaaaaaaagaaatatggaatacatttaacctacaaagaaacaatatccagaatacataaggaacatctaaaagtcaatcgtagtaaataacataaaagcaaactgaaaaatacttcaaacgacattattcagaaaatgtatcctaatggccgataaacattaaaaggtgctgaacattcttaatcatgaaaatgaaaaatagaccatactgagatgatcatttatcatccagtattaacaaaaatctagaaattatgacaataagttttgggtaggatgagaagcaatactgctttggggtatacaattgctttggaaataatttggcattagctgtaaagtttgaagatagacctatttacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaactatagagaattttaggagaatgattaaaagagattcagaataatggtcacctgtggagggaaggagggggctatgattggagaaggtcatgctatctacaaatgtgttgttccatttctcagtctgatagtagaaagatatttgaacatattattgttcttcaaattgtatatacattttaatattttataaatatattctgcattaaaataaaaagaaaataggaatgatatggaaccagcaacgacagacaacttttttaagaattttttttttttttttttttttttttaacgaaagctattgtcttctatggaaaatgttgtttgacctattagcacttgattaggttcccctccttttcctgaaacactataacttttccctatcatgtcttgtactaaatttatgctagctgcaatgctagataacactcctccagacaggtcttagtagattaataataaatgtttatttcttgctcaagtaagaggaaaaatgagattacctataagtagcagctcattttcaaaaggtaattcaggtaccttgtatctttaaatctggtggctctgctattttcaacatgtggcttctaaggtctctgtgagaggagaaagaatgggggcttgcacatgtgggacattttcatgagcaaggcctgcattttcctccatatgctgttgacagaactcaatggcataggcccgctaactggtaatgagctggcaagtgttgcctagctgtgtgtgcaaaagaaaaagagacagatttttttttcaatagctagccattttatccatctactttccaaatatccacttaaatctttcttctttgcttaggacccatttaccaagggtgacagtccagtcccatcaccgttttgagctcaaataacaatatctccaggcagtatgcagtcttctccatccattgtaaatgtgccttcttgcggtcttgcaatctctgaattaaaaagacaagttgtctccctttcacatcttcccctctctccagagtgggagacacataacattcactggtacatggaaagaataatattctgcaggagggtggaaggggtcttttcctagcagttctccttggctcttatcactgtaggctagtgcatagccccatgcctattgtatgactgcactgtgtcagagttcaatgagttcaagtttgtactattccctgttcatgataagaactatataatagttaattgctgatagtattattatattacaacaagctcaagtaccaagtgtctttgactttggctgaaattatgtgcacactaagactagttaccatggtcatcataagctataaatggtaattttttctatatattgtttaatatgtgtgtgtgtgtgggtgtgtgtgtgtgggtgtgtgtgtgcacatgcacacatccaggaaaaattattacttgacacctactttttcttgtaaacaacaatttatagtaaatatggaaggaaatttaaagggtctgtggcttgaacatgttggaaagtcttgctttaaagctccagcagatcctttctgtactaaggcacaaaagctatgatttttcatctgcccagaataataaaattatttacaaaagcactgagaattattctttatatgatttccaaccttcaagcttctgtagaaacattgtagctttgtaaaatgtggtgccttaccttggaaaaaaaagctttgttttgaagccgaggaatagtaaagaaaactgctatgtccctagcattaaaatcttatatcctcacaatgtgaacatgcaaattaactagaagaaactacattttaaaaattgaaagatttttttctgagatgcctttgcattttggttatctcttattggtcaaccccaggtcagagttaacacacctggctctagagtaatacacatgtacaggtgttgttaaaggctgcatgatggtattctgagcctctgctctgagctctgtcctagatataaagaatgtgcagccagctgtttgtctacttgtcctgaccctgttcaaggattaatgaagagatcctctatctgtagtccaatgtctattgggtagggaccagaaatgattgaacgtctttgcttcatgatacgctgtgccagtatacatgaaaatgggaacctaaaagtactttcataagcactttgtggaacttatttcttcctttaaaatgtcctagacaccttattgtcacctcttggctccctctggtttctgtattttcactggtacattggatcaccatggcagagccctaccctgcacccaacccaatagcaggaaggtttaccttcagcttgttccctgtatgctcagtttccggtggatttattactgtttttggttgtccccagaggctggcttatcatgaagttaaggatcttgatgcctcagggcttttcacttacatagaaccttccaagcccatgggtcttgaatctttgctaaatcggtccttgctctgtatggtactgctttaactgaaacacacacaggaagctgtgtccttactttgcacagatgtattattcaacactgtgaatactgtagtaataatttttggtattttccttgtaaaacaaagagaaaagaaaacaaaatacagaattgtgctgcttttattcactgagtagtgtttcaaatcaagctagctttctggcagtgtgacatcatggcttagcaaagagtccttagaattttctaacttttaacaaaatggggaccttaaacaatctattctctgaaaaataatgttgaggtttcacagtaggaatgaaaagggtgggacgattatgatataactaactcaatttttaatgaataatgaattgcagagttaatgcttgtcagaattttccaggaattagggagaaaatgaggaagaaaattttacaagtagagttaagaggaagaggtagatgaatgcacgatcctgcttttattttatgactattaggatagagatgtttgaaacctgctgagtagctggtggaaggggaaggcttcaaggataaatagtagatggccatgcttgtcccccgacacagggaacggcctgcgcaaacacacttggtttgaggatatctgatgagttcaaagtgctttaactactaagcaggtggaatggcaggatataggagtcgtggcggccactgtaaaactcggtggttcagatgtgggtgacatgatttgcaaatataattacaaagtgatacgaactgttaaattggacaagtttagatttaggtgacagtaggacttagaagagacatctctatatttcctatgctaagctggaggtaataggagaacaaactactttatccacccctgaaaatgagactgttttactgatggaaacatcatcgtcttgaccatgagaaaaatccaagctagaatcctggccctgtggtttactagccaagattctttgaggggcattaatatttctttatgtatacattgagactctgtgatgatacctaccgcttatgcttgctgtgagcatgaatgagccaagatgtactgaagagccatgttaaatacctgtagatagttaataaatagtatctttattgttatcaagtaaatggaaagaattcaaaagaagggagaaagagagaggaatagtaaaatgtcatgagagctggaggttatttgaaaaatacatgttaatcaattgacgttatcaatcaagtaatcacgagattaccacagatacccagcttggggacaggaccacagaagaataatttgtgctgcctctcttgacgataactactttggttgaaattctgtatccctcttactttgacaaatcagaatcaagcgtggttgaatcttaaagactttttttttttctgaactaactcttactagttggcacaatagttaaatgtgtaggaggaaaagaggatgacggagaatgcatattttggtttggagagaacaaaaactgccctaggataatgtttgaatacatggccaccaacaagcccaagcttttgtggaaaaacactaaaatggctaaagcctctcagcataactgctttgctaatttaagtgtttgctttgagagtatgtgaacaaccgaattttcttagttaaatttattaaaaatgactgtacaggatggaattggccaatcagacaaaaacagttcaaaattagacgacgtttttcatcacttcacacttttgcagtgtttgctacaatcaagacactgtgcttagatgctgaacgtgatgcaaaggagttaaagatgtagtccttaccattgatttattggaagcaatagcatattacaaatactttatcttgctctacaggtaggcccgatacaagaagtgttggctatgagtaataatttggaggttcttcaaaaaactaaaaatagagctaccgtatgatccagcaatctcactgctgggtataacccaaaagaaaataaatcagtatatcaaagaggtatctacgctctcatgcgtgttgcagcactgttgacagtagctaagatttgggatcaacctaagtgtccatcagcagttgaatggataaagaaaatgtggtgcttatatacaattgagtactctttagccataacacagaaggaggtcttgttatttgcaacaacatggatggaactggaggccattattttaagtgaaataaaccaggcacagaaagacaaatgtcacatgttcttacttatttgtggaatcttaaaatcaaaacaattgaactaatggacctagagagtagaaggatggttaccagaggctgggaagggtagtgggggctggtggttggggaggtaggggtggttaataggtacaaaaaggtagttagaaagaatgcataagacctactatttgatagcacagcagggagactatagtcaataataatttaattgtacattttaaaataacctgaagagtgcagttggattctttgtaacccacaggataaatgcttgaggggatggataccccattctccatgatgtgattatttcacattgcatgcctgtatcaaagcatcccatgtaccccgtgaatatatacacctactgtgtatccacaaaaaaagtgttggaagagtgttgtgggatttcacacaaggcactgcctgggtttgtgtcactgctctgctctcctataccactcttgtcacataagcaagagacacacagtctcatatggagtgacaaattcggaaatggaaattcttttacagttaattaattcaattcagagtgtctcctcatcatcatccagcatttcctgagggtacctgttttgtgtaatgtggtaagcatagtctcttctcttatattcttccaattaattactttttctagagtttaggcccttctgccggagggagatgcctgtgtggtcacaagaatatttttctccctgcctccactttgttttggtgaccttggccatgttagttggctttattaggcttccacttcacaatctgtcaactcgattaacacaggcctccctggaatacctggctgttttgtttaagatgaatctaggaatatgacttgtttcaaatccacatgtcatcttgaaatgagcttgtctgggtctttagggttgaaatatatcccaggcttcttggctgctgatgtatatttactattttaacttcagttatctttttagtctgaaggctgaatgacttcttacagtgatcaacacaaagattatccagtagtctttggttgaatttattgtcttgacttcaatactatctatcagcaatactttgcaaggtcaacttttaaccatttttgttgttctttgccaaacattgcataaaataaaatataacctttcttctaccatattgtaatactgttgtaaaaaattaaatgatttcctactattccagtttattctctgtcaacattcttttcatactaaaaaggttggttttagcttatagatgaaatgtttttctccaaacttatttatgataataacaacaaatacttttatagtgcttagtatattccaggcactattataaacattctaaacaccttctgccattaactcattgagtcctcacaataatcttatgggtactgctaattgtgcccatttcacagatgagaagattgagggcaaagaagttaagtattttgcttatggtcacaagtgattgggccaatgtttgaaccaatcacttgtctgaaattttgcctttaactatttcacattttgcctcactgttagattttagttctttgttctgaatttggaatgcgtataaccatacaagcaaacacaaatttttattttttaacttgtaatattatggctgacctagagcagtgacatttttagtccaagacctagatacagacaacaggagatcatgtgtaaagaaaatagaataaaggtccttttttcttatgcagggccagcccaagataaaattttgtaataggttgaagtatatctttggcatcttttcacctttctctccctctctcaatttttggcactcctcctttcactttcatctattttttgctccactttgattagcagtagcctgtctaatccctgagagtaacccatacatcagacagaaactccaagtacagtgatacgggaatcaatgtaccctacctctgaccctcaaatttctcctctcagattctagcctgagaaaatatactgaaatgcaaaggtttttgcataaagatgttaatcacagcgactttcttttcagtaataaaaatttgaaaactgcctaaatgtacaacattggaagaatggttaagtaaattgtgcattatacaatacaatgcagcattatgcagccattaaaaactatgtttatgaaaacttctccatgacagaggatagtacataagtttaaatgctaagaaaattcaagttgaaagtagtataatatcaactctagaaaaatacatataaaacaaggaaagaaaaagctccaaatattaaatgtatacagattggatataaagtgattatttatagtttattccgttttctaatgtattagttttacaatctagaaaaaataaatgatcagtttttataaaaaccttcattcacaataaattgcaattttttcttaatcctcctagatatattgtcattttcaaaaatgatacttgccaatcccagtgtctttaattagtaggattctaagcagcacaagaaaatatagaaaaagattgaagaagtgtagagggaatatattcaaagtatgtagtatgtaagctgaaatagagcaaccgcaattgaattctcagatcactaaacttttcttgctttacacaaattttatctttcttaattcaattttttctttttcttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatatcttcatagatggtggaattataaatggattacatatatcagatagaattaagtgtttgcaaattaaggcttgtttatactcttttgcaagcaatattttaaaatctgtttgtttattttttttatttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctacagccacagtagaagaggaaaccagttactgtgattccaaatataatttcccaggaggtgaaattccctctcctaaacatgaattggttacaggaaaagaaaaaagaatgtaattcgtaagactgtggagccattttcctaatccaatttctcctgtcccctagatcgatatcatgtgaattgcttccacaggggactgtgctagcagagaggggtctgtggaaagaaagaagcaccgtgctccaatggaccattattattgtttccatatcacagggtccacatatgcatgtaaatgtttttatagtacacatacacaaatgcaaaactgaatgtctaactaatgtcaagcacggtcacatacacccacactctctaatttcctgtccaaggtggtgatctgtaaaagagaggtgaactgtaagagctgaatgattagaaaataaattctaaaactcaagtgcacttaacagtggacgtaatcagtagagagaactaagacctttaggattctgatgcatctgtcacctgtaagtaaactgacagttctgtttttttaattattattaagcatgagttgctatataaatcacatctcattacaacaagccacaagtgactatctacatttttatgcaaaatgaatgctatcctactaaatgagcattgcctaatattgggagtcttttcttggtcatgcagtgatatttgctgataggggatttgacctgtcatagctttcttctagttttgtagacatttcttgttctctacctccctggttcccagcgtgcttatataatttgacaatatcttttggagcaatttgaaaatatgaatctcaggtcattggaatttgtgtattctaataaaaactggcataataattcagaagtggaattcattgaagaattatgggctcccaaatgctagtcaaattattttttatagaggtggaaagaaagggtcattctgtttttatttcaatccccaaagtatagattaaggcagcagtattctaggtcttacacaatcataggaggtgggtaacattgcaggagaggaggaaataatattcgttgactgtttactattggcaagacatcttaccaacagtttaatactctttgcaactctgagccagttggctctctctgtatatcacttttggaaaagctgaaatttgtaaattagtcccaaactctaggtcagagggtaggggagtgaaggaaggtttcattaaataaatggcccttgggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggcagtgctttgatggccattttaaggaattttaagcaatgggaagcttgaatcaaagactgtaacatgagcagatgtgctttttcaatacattattatagttgtggtgtggagaactgactgtgtggacacagacagactttcacttcaatcatctggatgaaacagtggtagcttagatggatgtttgtggtagagatggagagagatagagagtttggggacgatgggcagaattaatagaattcattgatatgaagatgtgaggaggtgaggaagagaaagatgtttaaggtgacatagaactctgcatcatataataaaatggatgggggtgccgtttatggagatacggaatgctcaaagacctgagttttatgaatttgatcatttttctaaataagtgcttgattaggagcatggatcacctatttggttttgaacatgtatttgccattcctgtgactcatgtaaaagaaatgtgaaaaggcagttggatctggactctagaagagaaatctagattcacaaactcgggaatgagcattgatgagaggtggagaactacaacagttattagccacatccaggagaatgagcctacaaggagaaacagaataatccaatagttaggaggaaatcaggaagatgactgttttgtggaaggcaaggtaattgatgtttcaaaacaattttgttggtttttgataatgtggaagttatgggcaagagaatgcttgggatgctcaaagaccagcaagaagaacagagtgactggagctaagtgggcaagatgattagatttaaaggttgattttaggtgtgatgagaatgcattaagaggttttgagtgaagaggggatatgacctgctttacattgtcactggactacagtgatagacagtgaaggaagcagggatggaagggcttggggggagaccaattaggagactgtgcattcaacattcagctagtatttatttaacatccagtatatgccagatatctgtaatctaggcttgtcatttggacttggacaaggaagaagtaatcaaatttgagatatattttgaagtcacagccgttgggatttgccaatggattgaaaatcgggatgtgaggaggagatgaatcaaggataatttcatggttttttggcttgggcaatagagagaattgcagtggggctgagactggtagccatagacaaggaacagaggtgaatagggagaggagcacgagttcagttctggatttgataaggaaatggtaatttttgtttataagattcttatgaggataaatgaagtaatgtctgtaaaggactttataaagagcataaacacttatcataagattattgttgttactattattagagtgggccatagtgaaaaccagtattctgatttgttgggccacctactgtgttttattcttggctttgtcactaacttgctgtgtcactttgagcaatttattggttctttctcaatctcaatctcttcctctctgaaagtttccaaagtgaacattagagatggaattgactagaagatcaggaagatcccaatcagctgtaacacccctatgatataaggctgattagtattatctcagtattattttttacattattgatattgatattttacttttatacagaagccaccttccaaagtagatttatcatattctaatgagcattgtgaatgatctcatttcagagataaaaatgttgaagggctttaattatatttaaagaaaaacagcaaaaatgaactcttatgatgaaaatcagtcatcaaaaaaaaaacctgagagatgagaaactacaacaattatccaccctcccaacatgtatgcagctattttgaaagaaaacatttggtacctgttgttagattttggaaggttacacacaaacttggaaaactgtctaaagaaaagccaagggatttttgagttttaattacttcttttaaaaagtaaacagtagtcaattaaggagccataacttgtcttctattattaaattaatggaatcatgcagtaaaatatcagtggagactgcggcattcacctggacagacactgctgttttaattatctatagagtcaaatctatccaaacaatcactctcataatgtaagagaaggaaagaaaaactaaaaactagtccatctctaatttttctcatatatcagggtttttttaagtttacttgctcttcttgcctccctgactcaatttcatccctagattattgcagcaatatcagcaactattagttattattttagttcataactatttgttattctttggatctaagttactagtatctagagtggttctgaatgaccaggtatgagcagtgtggaggattggaaagcacatattctgaagaggtgttgaactgaaacacatccttctaggtacttagctgttttgtttctaacaacttaaagatgttaaagtatgttgttcacatctgcctcaatataagtggcagaagcaacattcctggtatgaaaatatgcacccagagaacttaaaatttccttgatcaatgttaacctgctgttgcagccaatgacatatcttttacctagagctagaaggtactaaggatgaaatcttgtgggattcccatgtaatatagtctgaatgtgtgtctctgcccaaatctcatgttgaattctaattcccaatgttggaggtggggccttgtggcaggtaactaaattatagggatgagtttctcatgaagagtttagtactatccccttggtactgtcctcatgatagcgagtgagttctcctgagatctagtctttaaaagcgtgtgatgcttcgcccctctctctcactcttgctttggccgtgtgacgtggctacaccctctttgccttccaccatgattgtaagtttcctgaggcctccccagaagctgagcagatgccagcatcatgcttcctctacagcctgcagaaccatgagtcaattaaatccccttccttcaaaaattaaccattctcgggtatttctttatagcaacgcaacaatgaatgaatacaccatgggatgctgctgatgtttggatatcctctcacttctaatccctggaaagaaaaccttgcattccagagcattccatctaagcagctggaaccactccttaggtaggatctcagtggcccctgtaacaagtactatgattatagtggacaagtacaactgctcctatctattcaaatggaagaatgaagggacaatgttatagttacaaaaagtgcaaaattttattgcaaaacttcctagtaatgattctaattatctttattgaatgtctgccattttctaggcactggagtgggggttgatttggtttcccttatctacctattcaggtagataagggaaatttacgtggaagctgaagttccttactagagagagcattatcacctctaactctgaacccagtgggcactgctagttttgtagttcctggagttgcactctgcctttttttcctcacacttataactacttctccagctcctgccctggacaggcctgcactgctctgggcattctgcccactaatgactagtttttggctcatttcctccagaggctgcacagggaagagtgacctgtgtggccttatctgtaccatagattttctttcttgtgtccagctgtaatcccaatttatataaacatgtctatacctgagaccccagtcttgataccccaacatataacgtcttgctaatcaccctcacatagccctttaagaaggtattttataattaagagacttgaaactgagaggcttacttgcccaaggtgcttgggaatgcattcagatccacactgtgtttactgtactgtgctgtctccatcccattgtacattactcatttgtaattccagctgcttttgtttgagtgactagcaagtgttcaagtttcactcacatgccatactcttagaggaagtaaataacgtgtttcttgaacctcactgtgttcaggaagtactttatttaaccttgcctgcgggttaatgaatccttgctctgcttcctagggctttatgtatgattaaccaatatacctgactatatatttgaaaagttggccaaatactatatctggggcatggggttccactgcactgcagcagcgcgtatttacttgctcccagggctgtccactgttatgagagagagagaattcctactctgcattctaccccatcaccaactgcaatgtgagaagcgaatcacaattattttctcagtccctgaagtatttgctccagaaggctttatttgatgctagaaaaagattttcccataggatcaagcttgtttatggtggttaagaagaccaagaggggaagaaaatctgttagggcaatgtcagcttaagagagaagctgaaattatttattttagcaccttatttctacatacccctctgtttgattagctagacatctaaatccatgcaaagcattgtttatataacacaatctgcaagatccttacagtcatagcatcttcatcctccctcccctatgtaggcttacacaattgagaggagacaactgaagtctcaattcacgtctcacatttcacacaaagaacatcagctttttgtatcatttactctttacaaacatactattgattgccataaaaaattatctctgataacacactcataacatcctatctgttatttacccatctctgtgaaactgattatgagatttttcccaggtgactagcaggaagcaggtctgttaagggcaaaggaggaaggggtacagcttgttttgtgctgaaagaagaccagagaagtcagtgaagtcaacctcctggacacagctttttcccaagctgaccctgttgactgaggaatgccgagttacattaatgatggacactgtctgcccatcatggaaagcggagagctacatgtgtgggaaagggtagtaaactcctcctccacaactgtgcctccttccaagcttagatgacagaatattagtgtctgttatccttacgacatctctccatctggtcctctcaggatttactttatggtctgttttatttcccttttactactattagaaacaaacagctgaaaggattaatcaaaaatgttactgcttcaaagagtaaaaaacatgttacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagtctattgggtcagggtattagcaatacattaaccaaaccgttgaagacaaggggccagacatattcaaagtgtgatccgcattcaatatcaccattctcttgcaattgcaaagttataggcatcctttggatttttgcagcacttattttataagaaaaggagtaaataaagccacatctctgggatatgctttgagatgtttaagattgggaacattttcaggctgtctcaatactggaaatttgttgtccttttttttcacacattttctccctcttatactactctttaccaaaaggtgggtaaagataaggagatgaaaaaaatgttgcttaagtttttggttgccagctctgttttaagcctgacatagaagggggttgaaatttattttcatcattcagttaagagctattcttggctttcacaaatctcagtcctaattctgttattgtttcagataatgtagaatttgtcacattggctaaaaaaacaactccactaaatcaggacattagttttacatttcactgtgctacattctaaaataaaatgaccatttgtgctggggatgattttagaaaagcgaataagtaatataaagttttcctggttttctcatgggcagcctagaaaaatgccacaccaagactcaagaaattacattctgaattttgcatgaagataagacttgaagaaatcttatttcaacttatactttcctcagtttatgtcctgtaggaggaccctgtagagggggaatgcagaagaccagagggaagaaaatagatggtgtcaattgttatcaacacacgatagtatcacatttttattgagatataatttatatataataaaatatgagagttaaagtattaagttcaataaattttgacaggtgtatatacttgtgaacaaaacttcattaagatacagatgaattctgtcattctagaaatttctttatgcaccttcccatcctttcagaaaattcctcatgcccctcactcctccttctcctctatcactcatagaggcaaccactgatttctgtcactatagtttagtgttagctgttctcgaacttcatataaatggaaacatacagtgggtactctgttgtgcctggatttatttatttatttatttattacacctttaagttgtgggatacatgtgcagaacgtgcaggtttgttacataggtatacacgtgccatggtggtttgctacacccatcaacctgtcaactacattaggtgtttctcctaatgttatccttcccctagactcccaccccacaaaaggccccggtgtgtgatgttccccgctctgtgtccatgtgttctcattgttcaactcccacttatgagtgagaatgtgcagtgtttggttttctgttcctgtgttagtttgctgagaatgatgcaatcccattactgggtatatacccaaaggattataaatcattctcctataaagacacatgcacatgtatgtctactgcagcactcttcacgatagcaaagacttggaaccaactcaaatgcccatcaatgatacactgaataaagaaactgtggcacatacacaccatggaatactgtgcagccataaaaaaggatgagttcatgtccttttcaaggacatggatgaagtgcctggattatttagcttggtgtaatggttttgagatttatctgggttgttacatgtactagtagtttatatcttccattgtgtgagtatgccacacaatggatatttgggttgtttccagtttgggaatattatgaaggtgccatgaacattcatgtacaattttttatgccaattggctttaatgtctcttgagtgagtacttagaaatgggacggctagagcataagctaggtgcatatttagatttatgagaagtggttagttttccaaattggttataccattcttcactacctgttacccactgaatgacatactctgtgttctagccaatgctttaatgtcatttacctttttaatatgttaaagggtgtgtagtagtaactcactgtggttttaaatggcatttctctgatgaataatgatgttggataacttttcttctgcttattggctacttacacatcttcctttgtaaaatatctatgtcttttcactcattttaaaagtgaatttgtcttcttatagatttcatacatgttccttacgtattgtggatatgattctaatatgggaattgtgaatattctctcccagaatgtagcttgccttttcaatttcttaaaggatgtcttttgaagagaataattttaaaatattgataaaccctattttatcagtgttttctgttatcattagttttagcatactgtctaagaactatttgcctatcaagtttatgatataatctctttttttttcttctaggatcttcagacttttagcttatacatttatggcttatataatccatctcaagtaaatcttcatgtatagtataaggtcaagattaatttccttttcatatacatatccacttattctagtacattcatcaaaaagatgtttctctccacatttaattgcactggtgccttttacaaaagccataagtcacttatataagtgtgagtttattgatggactccatattttgttgtctatttgtctactgtatgccagtaccatactcttagttaaattttaaagttagttagcatacgttctctaactttgtttttctcttttaagatgttttagcaatttgaaatcctttaaaactacatatgaattttaacatcagcttatcaatttcttaaaaagctggctcagagtttgattggtattgctttgagtctataggttaatttagggagaattaatatgtttacaacatttagttttgcaacccgtgagtctattatctctctcaatttatttagatcatcactaatttatctcaccaatgttttgtagtttcagtgaagatagcctaagtcttttattaaatgtattcacaagcgttttctagtctttgatattgtaaattgtatagaattttaaatttaactttcaacttgtttttaatggttagtagcagttacttcctcctctgatatcctgaacccctcaaagttacccatgcggattggaatcaactttgtccaaactcttgtaaatgttaatattttgatttaaagtgaaagttgtcctgaatggtaacgcctaggttttcttctagggtttttatggttttaggtctaaggtttaagtctttaatccatcttgaattaatttttgtataaggtgtaaggaagggatccagtttcagctttctacatatggctagccagttttcccagcaccatttgttaaatagggaatcctttccccattgcttgtttttctcaggtttgtcgaagatcagatagttgtagatatgctaccattcaggacataggcatgggcaaggacttcatgtctaaaacatcaaaagcaatggcaacaaaagccaaaattgacaaatgggatctaattaaactaaagagcttctgcacagcaaaagaaactatcatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacaggcacttctcaaaagaagacatttatgcagccaaaagacgcatgaaaaaatgctcatcatcactggccatcagagaaatgcaaatcaaaaccacaatgagataccatctcacaccagttagaatggcaatcattaaaaagtcaggaaagaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacagtgatagaccggattaagaaaatgtggcagatatacaccatggaatactatgcagccataaaaaatgatgagttcatgtcctttgtagggacatggatgaaattggaaatcattattctcagtaaactatcccaaggacaaaaaaccaaacacctcttgttctcactcatagatgggaattgaacaatgagaacacatggacacaggaaggggaacatcacactctggggactgttgtggggtgaggggagtggggagggatagcattaggagatatacctaatgctaaatgacgagttaatgggtgcagcacaccaacatggcacatgtatacatacgtaactaacctgcacattgtgcacatgtaccctaaaacttaaagtataataataaaaaataaataaataaaaataaaaataaagtgaaagttgtgtgactcttcctttcacttgaaaacttagaggttcctggagggttattaattgttttaatttcactattgttttgtctcagggaatagggaggccagaggagagggagtgagataaggaacagacagtttgtggagcagttagaacacacataacatttgttaagttgaccatcttgcgtgggagtgatttgtggtgccccaaagccattatggtagtaacatgaaagatcattgatcgcagattaccataacaaatataatgataaaaataatgtttgaaatattgttagaattgccaaaatgtgacacggagagatgaaggaagcacatgctgttggaaaaatgatgctgatagacttgctgaatgcagggttgccacaaagatttaataggtaaaaaatacagtatctttcaagtacaataaaatgaggtagcttctatgtccttgtatgtttcatgggactttctatgtgcaccattatgtcttctgtgaataaaggcagtttaacgtctttgacaatttttttgtatagcattgaaaaagtttattttgagttaaaaatgtgtccttgtaaatttcttttctttttttaaaaatttcttctaaaaaaacagggtacatgtgcagaacatgcaagttggttacataggtatacatgtgacatggtggtttgctgcacctattgaccagtcctctaagttcccttccctcaacaggccctgatgtgtgtcattcccctctctgtgtccatgtattctcattgttcaactcccacttacgtgtgagaacatgtggtgtctggttttctgttcctgttttagtttgctgaggatgatagcttccagcttcatccatgtacctgcagaagacattatctcattcctttttatggctgcaaagtattccatggtgtatgtgtgtcacatttcctttatccagtctgtcactgatgggcatatggactggttccatgtctttgctattgtaaatagtgctgcaataaacatatgtgtgcatgtgtctttatagtagaatgatttatatgcctatgtatatatacccagtaatgggattgctgagtcaaatggtatttctggttctagatcctagttatgccttaaacttttattttctgtctaattgctctagctagggcctctagttacaatgctggatagcagtgatgaggtcagataatatagtaattattaaaacttcccatataaagaattcttgatccagatagcttcattaattctctaaatatttaagaaaaaaagatactaatcttatgcaatttatttaagaaaataatggagaaaagaacacttcccagcttgttttatgaggctagcattacttgacatgaaaacctgacaaggacattattagaaaagaaatcatggaccaataatgttatgagcatagacataaaaattcgtaataaaacattagaaaattaaacccagtgatatgcataaagacaaatttaccagggaatgcaaggttagtttcatatttgaaaatcagtagtgcaagtcatcatatttaacagaataaaggagaaaaatcatataatcatctcaatagatgctgaaaagcgtttgaaaaaaaggtaactcctgttcatgattaaatctctcagcaaacttggaatagaagagatatttctcatttgataaaggaaatctataataaacctacagcaaacaacacatataatgatgaaacattaaaacatttctctgtggaatttgatcttacttgcttatactttcattaaatgcatatatgacattttgtaaaatctcagttgctattattgtattattatgacctacatttagttagatgaaaaacacttttctggtacccaacaatttgtcattgccgtttagataccatttaacagtttttctgttgcatctacaagctgggtccacaccagattgggagcacactccaaagcaggacttctctgtttagcttccccctttccatgtttaaaaactttcaactgtcagaaaaatacagggaaaaatgttgtatcatgaaaccaagtaatggttcttctattaactcaaatactaaagtatgactatttgattagggatgctagatgtgagaatggaaataaagggatacaagaggcatttaaaaatagatagttggccggacacagtggctcacgcctgtgatcccagcaccttgggaggccgaggcgggcagatcacgaggtcaggagatcgagaccatcctggctaacacggtgaaaccccgtctctactaaaaatacaaaaaattagcctggcatggtggcgggtggctgtagtcccagctacttgggaggctgaggcaggagaatggcgtgaacctgggaggcagagcttgcagtgagccaagatcgcgccaccacactccagcctgggtgacagagcaagagcttgcagtgagccaagatcgcgccaccacactccagcctgggtgacagagcaagactccatctcaaaaaaaaaaaaaaaaaagatagttctggaattctgagtgtacacagaagataaaggatggagataggatgaataaagaataggagattttgtacatgttattttcttttctgagattagtcttgcctcttgtctttgactagtcaattcctcctcatcttgtttttaatcaacttttttgagataatggtagattgacatgcagttgcaagaaataatacagagagatactctgtatcttttactcagtttgccccaacggtgatatcttgcaaaactataatacaatatcacaatcagaatattgacattgatacagtcatgataaatagcattttcatcactacaagaatccttcattttgtgcttttacagccatgatgacttccctcctgaccccattccctgcttagcccctggcaactactattcctataattatgtgatttcaagattgttatataaatgaaatgatgtagtataatatgtattgaaggtagatagagtgattcctcccacttcataattaattttttcaaatatatttagcaattctaatttttctcctcatatgaattttagaataatctatatatacaaaatattttgctgagatattttataggaattttgttaaacttgtaatgtcaattatgggagaatttacatgttttttatgtagtatcttcgaatccatgaacacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaagggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgttactgttttcaattttggtgttcacatatatattgctagtatatagaaacacaatttattttgtatgtttatcttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaaagcagtgagagcagaaatgcttgccttgtttctgagaatagtgaggaagcattcagtcttttatcatcatgtgtaatgttagctgtaggttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtatgctttgccagaaaggagttcaccttaaattttaagacaatgttgtggatagagaaaagaaaaactttctgtgtcatggaaaagaggtcagaatttgggccaagattttactcctggctcttttatcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagtcttcctttatcatttattgctttaccacaataagtcatttgtcaaggaggaacacgtatatttccctagagaacacaccgatatgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacgttaaaaaagatcccctgagttgtatcctgagctgtcgtagataagtgtcttcacccctctgttactagcctgtgttcagtctagtaaaaagcctgcaatgagaaaggaacaatgacttctttggaaagagaaaagtgtatatgttttggggtgggattaagagaaacagagaaaccaaatgttcctatgggaagctggaacttactcagcattcacttgagaggaaggacaacaagcccctgtgcaaacccctaggaaatgtcagtagagtcaatttctgaaaaatagataaacagcttggtaaagtaagctaaagaataatagtgatacatcccagattttccaggatatttctgattgaaattgtccaattcatttttggtgatgttttaatttttgatttgggaaacacgaacactatacttctatgtttagctttagtgatttttctgccacaagcaatactctagactttagttgagtttttccctcttaattaaataattcttatttgaatatatttatgtttattttaaaaaaggctactgagtacgagattaccacttgttacgatcttgctccttggagcagaacgtgacatctcatatgtatatatacttagctctcttgggcaaaagcttctccctttgttccacatggtcatctgaacattccgtgaagcatttctatcctcccaggatgttttatttcttgttttcatgggtgaagagagactgttttataaaagttttcaaatacttactggatttgtatcctaaagggagaaagcagcaggtcattttttttttctttcaagggcttgctgtaagttggtcttcctcttaacacgaagaaaagaatgacattcttcatgaccgccattgtgagtaggctgtattacattaaagccccattattagcaggctgtgccttggctgattttatagagagctcaggaacagaagtgtagaacaaaaacactgatatttttcactggcacaaactgcagatactttacttgttgattaatttgttaaaatgtgtggcagaacatttagttatcaggtagtcattctgagtaaactagagtcctatgctcctttaacaatggaaaaattatattttcctttttctaatatcccagtgttgtatgtatgctcatttatgttcttggtttaacaggaacattgaacattccctcactttgaatctactctaactcctgtgtttgtgtattttcaccacagtaagccataatatataaaatagtacaattaagaaaaccttagccagcacggtggctcttgcctataatcccagtactttgggaggctgaggcaggtggatcacttgaggtcaggagttccagaccagctttcccaacatgcggaaaccccgtctctactaaaaatacaaaaatgagctgggcgtggtggcagttacctgtaatcccagctactcaggaggctaaggctggagaattgattgaacctggaggcggaggttgcagtgagccgagattgtgccattgtgccattacactccagcctgggtgacaagagcaaaactctttctcaaaaaaaaaaaaaaaaaaacttaagtaatcttcataagtaaatgatatatacttaaatacaaattatcacatttataaaagaaattttctgtatttgtccaacatcggtcaaattccttaatcttataacaattgacacaagaacaagaactgccacccagtccacatttatcttctctatcatatttaagatattgcagggctggagtatcttcttaggatatactttcatcacaacagataacctattacatcagagattcaaagaagtagaatgggagagagaaggagttatattttttttaccctaaatgatgtcatcaagtcactatgctaatggagattgctgcacttgagattatgtgccttacaaaataatttaataatgactttagacagctgatatttcccatatagaaaataagaattcagcttatttatattctggaaagaaccatatctgctgcttagagtgaagcagacctgcagtttacacaacagttgagaataatcttgtttaccaagctctttggataaatagaaaaatatccaccttatcttgagttgctgtggtaatcagctgaattagtttactacttaagctctctggaagatgattggtgcatcatctgtgaagatgactggaatgttagcccactgaagttataacttgtggaacactgttcaaattaccgaaaagagtaaatcaactatctgctggtactcagttctcagggagcagtttacaccttgaaaaatcagatccaacacatactaaccatagtttctcatgttatgatttctggtggaattcctttagactcagccttattcttcaagatactgaatttttgggaaccctaagtacagtttctccttcttacatagagacttgatgttcctaactggtcgcaaacttgggttcatcagaagaatctgctccccttgtgagcacaaataatatctcagtgaagagaaagacactgtcatagaagagtcaacatttatggaatttcctggaatccacagttatcttaaactctgttccactttctctggacaccagctaccttcaatagtgccaggttcagtgtctaaccatggagtatctcatagttggactgggtgagtgcagatgcagttgcatgagattttgaaacatcacattataaaaaaaaattttcaggtatgcaaaaggcaggagagaacatgtactccttaccctgctttaaaaatttctcaacattttgccaattttgtgtcatctattccccccaatcataacattttttgctgaaatattgtaaagcaaatccaaaacattatttcattttacctataaatacttcaataatttacatgggtttttaatggcttgctatttattttcagggtttcttttagtatctttgacctctgtcacagctcatcttgcaaggttgcctatctcattgtcagagagctctagctaaagctcattcatcgttttgtgaactatgaggccacatattctgtgttgacccaagttgggccagaaagacagttttcaagagggcatggcttctaggtctctgccgcagcttgtccactttctttcattgtcagctactagaactatggcagcccatgctgggatataatttttcattgggcacagaaaaagagggtggcgttaggcagaatcaaaagtaggagctaagaaaatgaaaaagacaaggcagaaaatatgccaaaggtgcatatttaagggataaggggaggaatctgtgatgttgaggatgagtccccttgaagtaggggtgcacacaagagtctcccaacttgtgaattactaaggacaccaatggtgaactaatttataatagttgtctcctgtgactgagaaggctgagagtggggattatcagtaagaaaatagctcagaggcaaccaagttgtatggatctttagaaagggaagcaaggaaatagacaaaggacaacttcactgaaaacatttatgaagtattcagtaatgttttaacttctttttaatgagaaacagcaaaccctaaggggaaacactctggggtgtttatgtccagggtcagcaaggctccagggttatgtcttattcagacatattcaggagtaccggggagagagaatactccaggaaataggtgttggcatctgtggaaaggagagaaagtcagactgtatcctagagtcttagggataaatatagagtggaaaacatgaaatcatcttgtgaacacagggcagctattgaggcttggcaggtaggttggggttattgtgaaaaagttcccagcaatccaaagagatgttttatctttgacattgtgccgcctgtgccttgagttagaaaggtacacacacgtgtgagttaagaaaaacttctgatactaaattatttatagttaaacctctagtaaaaccctgaattcaaaaatatttgtagcagaatacaaatattctttttgttttgtcatttatcctggtaaaagtcaagttgctgcagcgtgatggttctggtactgaaatggtcttaggaaagtggaggaggagtggagttacatgtttttaaaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagatttcagtagttcttacatgcaatcattttcctttatagcatatggttcactgaaactttatcacatgtatagatttgtgtaaccaccactacaatcagaatggagatctcttcaatcatcccaaaggaactctttggtgcagtccctttgtaatcttgtcctttccccaacctaatgcctggcagccactaatctccatcattaaaaatttgtcatttcaagaatgttatatgaatagaataataactatgcaaccttttgagattgactttttttcccattcagcgtaacacctgagatttatctaagttgtgtgtttcagttgctgagtaagattctattttatggatgtaacacagattgtgtatccattcatgtgtgttgaagggcatttgggtttttttcccccaatttggggctattactgaaattatattttactgttttttcctaaatatatgaatctgaaagtgtatctgtatcatttaagacttaactccatgtggaattaatttctagaagcgtgaagaacaggttaccagttctcccaggattgctatgatgactaatttttagctgaataaaatatgaatatatctattcatttttatatgtgtcaagaatgtgctgagagttataggaaaacagaaaggtaataattgttaccaaatcatgaggagtgcccaagttctaaaaaacccacaaagtcaaagaatggtgcatggctatagtttcagaattattttctcagagagtgccagagccaatcttcttggtacctgagggtaaacacccaacctcttgttcctcacttagactttcttctatacttggcttttctccatgaagggtactgtttcagcacattggacagaaaaatacaagcacagtgcaaaaataggtgtgaatgttgtactgattcaggtaccagtatgtgttttgaaagttaactctgcttttctagtgatacttactttggataaaacctaggtcaagcctgttcaaaactgttacccgaaggcaattattcaacattataagcacatggtttccagatcattcatcattttatttaacttcttgagtacataaagtttttatcccatttgtgagtcttgatgcacacaattgactaactgtgtttgggttattttctcttccacattgggaaaaactatctttcatgatctatctcccttttcaaagctgttaaacttttgtcttctttaaatgattttctgtgatgatccagtgtttcttgtcacgtttctgtacctatatgtgctactgttgtgtatttgtttgttcatcctgcctctcccacggaaagacctgtcttctgttcttcgtcaccaagactctctacacagtaagggctccatctgttttgactgttgacctactgaagggacatgcctttgcggacagattcaacacaaggttgaggattaaacccaggcttattttccttcggattttctcaacaatccttccatctcctagtagtatctattctcttctagcaactttttttttaaataataaaattgccttggtcttctaggaccctctgggaaggtaggtgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacctaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgcccaaaaagcagcagacttactgtatgatatgtccatctgtgaaggtcctggctcagactgagctgacagtatggaagtctactctaatgcagaaaggttggaaacctgtaattattgttaaaagtttagggttgtggaacctatttttatagcaagacaaacttgctctggtattggcccatggatgggtaaaagaaagtaaatgctttcaccttttaaaaaggggaaagtgtggcactgtcagcatggctcagtgctcactgtcatcctgctgctacatcatgtgcttgatgcactgtcatttgggtgataacatcacatttaagtcatgatcatttattcccagtgtcagagtgaaggagtcctgttcatttgagtttcagtattcctcaaactggatttcaaaaagaatttcttccaaaagaattcatcaaggactaccgtaatttcataccaggaagaaaactgtcaaaatatgtcatgagtccaactaaaaacctagctcaaaccatcatagtctctcatccaaactactaaattgacttcctaactaggttcctgcattgactcttgctcctccatagtcggtgctccacacaacagccagagggatcttttaaaattaaaattctgttgaaaatataatacccatcacaaagcctttggcagttttctcttagaagtgcatgcttttacttagcttcaagcaatagtatcttctacctgtaggtcttctctctccatatataagtccttcctatcttttcaaatccagattttacattcgaatatccttcaggagatgtttaatgatccccccagctgataaaagttaccttctctgagttttttatgacacagtatttgtatattttatgccatgtatcagttttctaccttgtatcatagtaatttacgtaccttcatcctttctctactttgaatttattgaggacagattctgtgttttacaaatctgcattgggtactcaataaatatttgtgaaataactaaataaatgagctgtgttaaaattaaaaaaaaaaagaaaaagaagtgcatgcaataaaaatggcttgctatggctcacaggaaccaagtgtgatctggcctgagtcagtcttttcaacttcccctcctgccactctcccctttgctggctttcctccaagtacactggggtttttacttttctttggatcttcctcagggcctttgcacttgtggttgcctctactgggcacttcatattcccccagatttttgcctgactcccctacttcatttatgatcaacatgtaatcactccctcattctttccttattctctatcccttaccatgctttatttttcttcatgacccttatatatcttagatcataatatatatttatttgttggcttatttcctgccttcctgtctagagtgtaaccttcttgagagcagtgacattgtctttttcatactgcatcccatgcctgtagtgtctggcacagaacaggtttttgattaatagtctttgaatgggtgaaagagaatagaggtatctggcatagtcgggggtcaagtcagcctgaggtcaaatccaaatcttgtagattcgggatattaatcatttgttagatacatagtttgcaaatattttctccaattctgtaggttgtctcctcactctattgattatttctgttgctttgcagaagctttttatttaaattaagtcccagttgtctgcaaggaacttagacaagaacaacaacaaaaaacaatcccattaaaagggggctttaaagtacacgaacagacatttctcaaaagaagatatgcaagttgtcaacaaacatgaaaaaatgcacaccatcagtaatcagagacatgcaaattaaaaccacaatgcaataccattttataccagtcagaatagttattattaaaaagtcacacacacaaaaaaacccaacagatgttgatgaggatgcagaaaaaacagaaccattatacattgttggtgggaaggtaaattagtacaacccctatggaaaacagtgtggagatttctcaaagagccaaaaatagaactactattcaatccagtaatcccaccaccagatatctacacaaaagaaaacaaatcattttattaaaaaagagatacctgtactcatatatttatcacagtactattcacaatagcaaagtcatggcatcagcacctaagtgtccatcatggaggactggataaggaaagtgtggcatatataccacagaatacaactcaaccgcaaaacagaatgaaatcatgtcttttgcatcaacaggtatgaacctggaggccattatcctaagtgaaagaactcagaaacagaaagtcaagtatcacgttctcacttatgagtgagagataaacaatgggtgtacatagacaagatggaaataatgcactctgaggaccccaaaagcacagaggatgggaggggtttgaggtttgaaaaattacatagtatgtacagtgttcgctattcaggcaatggtcacactaaaagcccagactcaccactacacagtatatcaatggaacaaaactgtacttgtacctcttaaatatattttaaaaatccatactttggccgggtgcggtggctcacgcctgtaatcccagcacggaggccaaggcaggcggatcatgatgtcaggagatcgacaccatcctggctaacatggtgaaaccccgtctctactaaaaatacaaaaaattagctgggcatgatggtgggtgcctgtagtcccagctactcgggaggctgaggcaggagaatggtgtgaacccaggaggtggagcttgcagtgagccgagatcatgccaccacactccagcctgggcgacagagcaagactccgtctcaaaaaaaaaaaaaaaaaaaaaaaaaaaattcatactttactagtgggcgattattggaatatgaagcatttcagtttaactttgtaagctttagtctttgtgttttaaaatgtgtctgatgctgtcttcttcatagtttgttaggagcactaaatgaatagtagaaagcctgccagaaagtgatttagtctgaatctataaagctgtttctgagcactgactgtaaagtgcactagaagctcaaatttttaggttttgtcattttgtgacaggttgatgtggaactcgaggggttggccaaagccctcagagggttgtaggccatgaaagttcgagaaccactgggccatgtccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccatgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttgtcatttagcattaggtatatctcctaatgctattcctccccctccccctaccccacaacagtccctggtgtgtgatgttccccttcctgtgtccatgtgctctcattgttcaattcccacctatgagtgggaacatgcggtgtttggttttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcctcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagagctggagcaagacagagagcagcatacctgtaatacagcttattaaaataatgcaaacacttctgtaatatgtatgaggtgccaggtagtctgccaagaacttttcatctattaatttgtttagtctttacaactgttcactccacttcctgttagggagatagctgttgttggacccaatgtagagatgaggaaacactgaggaccagagagtaggcatccaaggtcacagagttgggcatgcgtggggcagagccccaggctcaggcattctggatcccaggcccatgtgcctgcatggtagagggggagctggcactagcccttgtgcccccaaatatcctggctgcattgttcccctgttcttagttcatttgtgttactataaaggaatacctgaagctgggtaatttataaagaaaagaggtttatttggcttggaggtctgcaggctatacaagaagcgtggcgccacatcatctgcttctgatgagggccttaggaagcttccacccatggcagaaggaaaaaggaacagatattacatggtgaaacaggaaggaagacagagcgggggagatgccaggctctttttaacagccaggttggcagggggtgtgtggggagactcttgtgggaactaatagagtgaaaactcagtcattaccttgaggatagcaccaagccattcatgagggatccacccctatgacccagatacattccaccaggccccacctctaacattggagattaaatttcaacataaggtatggaggggacaaatatccaaactctattatccccataaatggttaaactccgggagagacaactatgcacctctcaatcccaaggtgagttgggattcacgattggttaaaacttcatcagaaccatccacattggaaatcacatctaaaacttgagtaattttatggtttacaaagcatattgacttccttgatttattcatgttgccagctgccctccgaggcagaggatcttttcacttttctcctattactcaatgccactactgagcctctgcactgaccctacggcttcctgtcgtactctctgcaatgctacatgtcccttctagtctagggcgatcctggtggaagcatgaagccagccagcctctctctggtcaccaccatcacttcattccttatatataccaggcatgggaatgtttcttttgcttgttaatttttgttcttgctcttatctgcatttatcttccttcccccaagtgtactgccagaccctggagaacagggaggggaattgtttttcctttattattctttcctcagttcctgctgtagaactgtacatctagtcaatgcttaataaatgctggtaagttgaattatcaacactgaacgtagaaatgcactgttgcctggcttgttagttttgtaagaatagggataataatagtagcaactaatgtgtacagatttgactatgtgacattatttaagggctttgcacacattaatccatttaatcctctccatgacctaaagcactgctatgctgaagtgcattttgcctatggagaaatgactggtttttgggaagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttaacttcagatgctcaggaacgacagcacctgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatgattgaggtgaaatgagatgctatgtgtgcaaaggacctggtagcaagaatgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacagtggggatgactcatagaggaggtagcttgacatagtggaaatagaagctgataaggagccaggagacccaagttcctgtcctggatttgcacaaataaactgtaatagcctttaggcaaattattaaacatctcagttttctattatataaaatgagagggctgtgtttgtgaatggatctttcaacatgcttaaggttataccaaacagatcactgaaaatgaaatatgttatctacagtcattagggaataaagtattcttgctagtgcaatatacttatttggagaggattacaacataaacaagaaccaacgagaatacatcagtgccagaatgatacagacataagcagacacctgaggctctctgatacccgcaggtcattgctatgtcctaggaaaacatagccatgctagttataagagttttctgatgatgagtctttataaacagaggatttactgggaactagagatggaatttttaaatgatttccatgttatggatgacctgtacttgggcttatgatagctctgccacatcttgagaaataatttattgactaaactcgagttggcaaatgtaaaaactcatttgggttagctagcttgtttacttgttcttggcattctttcttcttcttatttcagttgtaggcatgaagccacattttgggctgatcatctttataataggcttatggttttataacatcagattttgaatgatagcattttctgctctctgtgtttcctatcacctgtagaattaagataggtcaaatatggaacagatggattgaatgattccctagaattattcactgacattataagggtgcctcctgtggcacaaatagaaatatttctgagagttgtaaaaattaaatttttaaaaatcgaatccaatttttctattgacctgcgttagaatttctgagacattctatcttcatttctgattgattttcaattagcaaaggttcctgccattttaactttaaatttcttagttcccctttttcctccaagtggttaatgatctgtgaacaaatattggagcaaatcagagatgcttcagtgtacagtcaccctatagatatttctggtgtgcaagggagtgagctacctgggagatgaggaaccttggttctagtgttttctctgccaccacagaggtatgcatctttgaataaggtctttttgcctgtttcaggcaccattctctcatttgtaaattatgagctccattgatcctatctggcttcaatattctaccgacaattgagtgggaaaaggaaactttctctgaatcataatctctcaacttttcttttcataaattttcttaaagtggattatacctatctgtaagtggataacagcctccatttattatccttatttttatttggctttttttttgacttgcaaattcctttttggatggattagattgaaaatctttgggaggctcaatcagcccagacagatttattcattctttattctggatgaagaagaggaaatagtttaagatagatctgacatggaacattaatttgattgaagcctttctgtgtgaggagtaattgtagcatcttcattgtcataatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccaatgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaaggtagccaagatatggctctgaattatagccagtcatgggattattatttaactccagtttagtatgtttcctgccaagtatgtgccagaccctctgaaacagaatctggtttttgccagcagtgcttagcaactctatattttaagtctaaattccaaaaaaaaaaggaagagtaaagaatactaaactgctttctgatgggagtaagttgtatttcaagtggcctcagaaatctttttctctagaggagactttctgtggctaagaggaagagagtgggcacttctcccctccactgaacccacctggacttggtctctctcccaaggctttcactgcaattgaaaggctttttcactgccctaggtctctctcctaaggctttcactgcaattggtacatgtgttcagtgactattagaacttaaatgatcactctcatcccacctcactgatctcattttccaaatttctccctcttgctctcccattctagggaatctggccttcttcttggtcttcagatgcactgaacatcttcctgcttgaggatgtttgctgccttaccttactctgctggaaagcaattccttccaatggtgcaggtctcacttccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagacagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagaggttcttaaacaactatccatgaacccaacgctgtgctttacaaaatttaacgtgcatgtgaatcgacagaggatctcgttaaaatgtgaactgtgatttagtagtctaaattggggtctcgggttctgtgtgtccgacaggctcacatacgatgcggatgttgctggttctaagattgcactttgaggagaaagactctaaagtacctgtggaagggattcaaggggttcacaaagccagggttatgaatgtccagtatcattgttatagcaaagaactgaagtgctagtttctagaaatttctggtttatgcaataccaatgaacagatcatttattggacattcattgcagagctttcaactgttaactatgcatggttgttctgtatgcagacataaatataggtataggagaatttctttttctgaggaaataatagaaaatattcatcagtttgtcaaaaggatcagtccaaacaatggtgacagccattgttaatggatgatggcattaaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggccaaaatgccctcaaaggggccttggtgtagaaaagctgttttcaggcaaaaaaaaaaaaaaacaaaaaacacaacagcccatcaagagctgcatagcttttcagtcaggaaacttacccccaggtggatgtttctcagccaaggagtgtgggcaatttagtttcaaaagtaatttggaacaactgagatgttttatattaaatggtcctactaaatagacatctagcacagggcttagccaaattctagaaggcctcgcatggtatggtatcacgatcctcataattgctaaaaatattactcataatcataatggctaacaattattgagtctaaatatatgctaggcaaggtgctactaaccttccatacattttcttatacaatatttataaaactaattcggatggtactataagtttttttgttttgcagaaaaggaaactaatgcatggatatgtgatttatattgctcaaggtgacaaaattgttgagttgtagaattgggactcaaattcagatatgctgattccggggctcatcctgctaatgactgtgctgtactcataatcataacaaattgatttttggtgaccttgaaaccctgcttaggaaactaaattttaagattttggttgaatttaccctcagggtggagaaaacacaggttttcataaacttactgtcatcaaattaactatcctatattatttttcagaataaacactcactacttgttaaggaaatcatggtgaaacttattcatatgagctaagagcttctgcattcccatttcatggaaacgtggattttccacgtgtggctctgtagcatggcaaaatagcttggtgtgcaaaaataccctagggtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcggagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaaaattggactcatggtgtgagaaaattccaaaatgtaggaagatcttcaaagatgttgagcagtcaccacgaggaagcttccaatgttgtgtatttcagatcagtgttgtggagtatctttccctttatcacacttttccttcatttttactccctttgattgctaaatctttacagagagcagggactctgttcattcagtccccagaatggcaatgtgttaagtccacaagaaggcttttcgtggacttttggagtctgatcataaaggagaaatatgtcttaaaaaggcagtggaggtgatgtggtgaattttgtgcttagcatttttaacttgagaaaaatgataagacaggccagtcaacacacaatgggcaaatggagataggtgactgtaattcagaagtgcacacaggactccaggtttgagtatgggagttgtccttcaaggattggcagttgaagcattcaccagagcatggatgtgttttctgagcaagagctgtcaataattaggatagaaaactgaacgtggaaccctgaagacctctcaccctgtgccaaagtccaggtgcagaaaagaaaggtgagcttgtgataaagagcaggcagagttcagaagacagccatattattttggtgtcataggggttaaaggaggcaattcatgagaattgattgcttttttctcactctttattgagatatagcttctcaaatgtaaagcatgatttgaaagagatcagtaacaacagttatgcattacatttgaggtgtgttttgtacttttcaaatttgttttcaaatccccatcacttcatttaacttcattcagacacttaaattgaaaattactttctatgtgtggttaaaaaaatcttgcattatttttgtttttttctttaatctaacttaaacatggaagaaaattcagttgtgtgtagttaatcacaggtttgaagaaattaccttaattctattttgagaaagaaagagtatcatgtggtatacagagtgaaggcttggatacctccgttgcacaagtttcctgcttagctgggacctggtcaggccacttcacctcccatttaaaacatcctttagaactaggtatggagctaatgttttagatatgaaaaataattattcacagcgtgttactataaaacatatgttcatagattcttacatttgtatacaaaacaagaaatcacaaagctttattcatgcagaaaaaattaatttgaaaaagcccactgtatgccaagaaatattcttgatgcttggaggtttggggttgaggtagcaatggggagataaaatgaatatggcttgcttcttgctttctgcaaagaattgagtttcgattctgacttaagagacataaacaaggaaaagtacattctccatgctgcatatgtgtggcttaggccctggcttgatgaagggagatttggtattttgttaatgtaggaaaaactaaaccaaagtgtcttttctattctctcatttaacagtagtcaacacagaagacttctgtgacctctagtcaccaagaagtgtgtggggatttctcactaccaacaaataaaccatcagttctgcagctgacactagctgggtgtcctctaattcaatgctactctgacactgtctacctggagatacagtcagatccctcagcttgagagctcagtccctaagactgtttcctcccctcactgcagatgccagtcacaagctccagtttgttgcgtctgtgcttccagccagctggctataaattggggttccctcaacttcccccttgggtttgattaagttggtagagtgattcacataactcaggaaaacacttacttacatttaccatttaccagtttattatacagaatattgtaaagaatacagatgaagaaatgtgtaaggtaaggcatgggtggtgggggacagagcttctatgcccttcctgggtgggccgtcctccaggaaactctgtatattctgttacccagaagctctctgaacccaatccttttgggtttttacagaggcttcattatataggtgtgattgattaaaccatcggaccctggtaatcaacttaactttcagcctctctccatccccagaggttgtggggtgaggttgaaagttccaaacctctaatcatgatttggtctatccagtgaccagcccccatcctgaagctacccaagactggcagccagcagtcaactcattggcatacaaaatacatagtttggaggctccactgattttcagtgtggtaccccaggaaagtggatgaagaccaaacatgtatttcatgaagccttctatttcagtagtaagaaaaatactaaattataatacgaatttttttataccagcaaagcagttgcatttgcatctttaaaatgcaagtgcaacttctttttagagatctattgcattttaaagatgcatttcatcacttattacagccaaatgacttgcccaggcattagattttctgttgcagtgatagcagggatttaaataatgattatcttctctttgacctggtgaatttcttattaccctgcatatagacatggttggattgtactgactttgcaaataccacacaactgaagttggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttattttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgacatcatcatcaagagcaatagctagcatttgttgaatcctgactatgtgtcaggcattattttaatcacttcatatattttaactcatttaatcttcacaatggctctactatatagaaacatgtattaacccaattttgccagagggttgagacacagagattttagggaacttaggcaaagttacatagctagaaattacagtcagtgattgcaaagcttgtgctcttaacttctattttatcttgtatctgtaaagatatttactaaccaagttaagtgtccttagagcatatttttatagtataaaaattgggaaaaaattaagataaagaaaaaaacccataatcctactgctgaatgagagctctgttaacattttgaggtacacatatttaggctttttccctcctttacatacattcacataatttgtattataaatgctcttttaaattaattttattcaattaatatattttaaaactttccccatggtattatttcattattattttaaatggctacattaagatatggatatttaggcttgaaataagtttaaacaaacctattgtcttcttaaatctccagtcatatttccatgaaggatggcagctcttagaagtcatggaagcaaagaacagtacccctcaggaccattgtaagaaaatgtcttctttgagagttcttaagactattagcacatctgaggacattttcctaaggattcatcttggtgtaaggacacactggggatattttaatttgtagtgatttgttgttgttgagcaataaacagtatatacctcttgaatttgctaaggaatgtgtgagcatacagtgctggtaacactacattagttaactctctttacctttcaaaactgatttaatgaaggtattttaatgccgtttcatagataagaaaatgaagtgcaaagtagttaacttgactaacaacaagtaagtgaaggagacataatttaagctttagcacagacaatctgtctcttatagtgaggcagtataacaataaatatgtggaggagatttctaaaatttccagtgtatgttaagaaaacaatgtattttatgatgttttagagaactgcccattataaccaactgataatgaaattcttcatctttccatgctatcatatttttcccttgtcagcacactgacctaggaatcaagaaattttggttctaatactcgcatttccacctttctgggtctcaagtttttatctttaacataaaaggttagaaaacttgaaaatcttaaagtctcttcttggttcagagagattagctttatggagttgtagagcctgtgtagaagctttataaagtggtttagagtcaattgacctcattggagaaaaaaagtagtcagtaagttcttcacctctgcaaagtgcagactgaatgtggagaacagaattgttgttttcttagctgtggctgtagcaggctgttactgattaccctcataagatgttttgaatttgtcttggaggaggtggctttcagcctgactttcaggctggctttgggtcatcctgagtaagaacaagactggtagtatatgctgccaaatgtaaaattatataactgcccaggagagctgtcacacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtttttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaagatctacagaaacagattaatatcattttatggcatactatgatctttttttagggaattaactaattactgctcaaggaagcatatccaataatatgcgggtaaaaggatataagcaaaaaggtagcagtaaatagctgtgttttggattccacaaggcttgtgttaggtgaggtcttattcagcatagttatgatgtggtaaagagagtacattgcccactaatacacatttcaggcattataaattgggaaacttgcaaatgcaaataagaaaggatgggtaaaatcaatatgcttagtgaagaagggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaaccctatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagctctgttaggagggaaaaatgatgatgttttatgatttcaacacatgacttcatttctttgagctatgtgacagtcatgctttcctccattattcatcaatactccccactgcttaaagttgcaaatatctagggctgggctacacaaagggaactgagagatagcccacccttccgtgcaaattttattgataagagtgatgtggtccagagacatgagacaccttgtccaggggtggttaatggtggagcctgaaggatgagcaggtcatgattctcagcacagaactctttttctcttgtagaaaagatagcaaataggctggatgaggtggctcacacctgtaatcccagcactttgggaggctgaggtgggcggatcacttgaggtcaggagttgagaccagcctggccaacatggtgaaaccctgtccctactataatagaaaaattagccaggcatggtggcatgtgcctgtagtcccagctaccgggaaggctgaggcgcaagaatccattgagcctgggaggtggaggttgcagtgagctgagatcacatcactgcactccagctgggtgggagagtgaaactgtgccaaaaaaaaaaaaaaagaaagaaaaaaagaagagatagtgagatagtaaataggttttcctcctcatgccaactcagatcagttgatagtacctgccagttgagaaaatttgtaaggacgtagtacctaggtactacataaaacactattgctattaataaataattatcactatcagtaattattcattagtactgtctgctatattaacaccatagggaaatagaaaatgtttgccacctcctatcaagaatattctttaaacatattccttcaagataaacgttcaatatttattctgcctttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcacatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggcttctgatgttgagtgctgagggaagctttctcccactgcttacatgttctagctccttggttggctccaaggagttgtgatggaatttcttggcatacttcaagccagcagcagccaggttggccttttccctccacatcttatagctttgtaggattttgggagaaaactgacctggaactagttacatgacctttttcatttatttgggtcttagtgctcatccttgtcacctcttattatttagaatgaaaagcacattactctttaaggaactagagtataaattcagaaacctagaacacatatattaatacacagaactttttctcttttcctagctgttcaaatgtaatacagttttatgttcaaactaaatgaatgcctatttattcctggaagtaaattttgttattttctagtccaggctctttgttttacacatgacaaaatagaagcccagtacacaggagggttgaatgacttgtttaatggcacatggccaaagaaacagaacagaaaaaaagaaatcagaatttgtcagttttctgtctagtgcattccaaatcacatgacacaaccattattggttttagaattggaaaagtttggtttattttttaactgactactcagattttaaaaaaattgtttcattaatagattagtaaaaatttaatactgctgttcattgtagggcttagtaagccattactatgatagatctttatttttgttttctttaagtctgtactggacattgaagtctctctatggtctctggacttacgtcttggccttacagactgtcctgtttcacctttgcctcagtctttgcagtaatctccctcactgagaagtctggaacatgccacatgttcacagtgaggctgttaaaacttccagccccatccaaaacctagacttggaaaccattgtcgcattgctttctgagtccacagatagcaaatgtgacaagtcaaaaatgatgcctaatgttgagcaaggagtctttaaaaagccctactcatgtttctaattctcacacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtctgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaacacctgatagaattgagtctcaatgaaacagaaaacctgctgaattgaaaaggggcttcactcagtgactaattttctaaagtgagtaccccaaactgttaataactattttaaagcagttggatgactacattcaagataaaaaattatatgggaataaaaattgtcaatatatctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatataatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttcccatatttccttccttccttctttctttcattttctctctctttggaatctcttctcttaactttatgttttccccaagtgatcagctgtttttatacttctctgctggttcctcctaacagagtctttgcagattttaaagtaaaaccataaagaagaaaacataaatagaatcttcagtgatttcacagcagaaaggcatggtttgtattactttctctcagaggtatttttaatggggtaaatatttatttccagatgacccaaatctctttgttatgtttgctgacagaaacagcagctcctccttctttctctctacagtaatgagattatggacagggatagaccttcttcatactgctctgacaacagacattttataaaccagggacgggctatttcaattcagtttaattcaaaaaaataattattggatacttaccacatctaggatattgttagctgttataaatgatacaaagataattaaaacattgttcttcctctcaaggaatttgtaatctagtatgagggaaactgtgtaaataaatatccaatcctggatgactgccacaacataaaaacacacaaatgtttaggaactcggtagacaagcaaaggaagtagaatagtaaagatgaatgtctcctatttgtcaatattttacttcacctctgtgttgttttgggatatatcaaataatgtcttttaaatttagagttattgttactttataataattattattattgtcataggtagtgttaggttgtgtcatttatgtaaatacttatggagtagtaacatgatatagtagtctacctcagaaagagatttattgagtctatgatgctgaattatagttttgtaatatgtttctaaattctttatgatggagtcccactctatcacccaggctggagtgcagcagcacaatctcagctccctgcaacctctgcctcctggattcaagcgattctcctccctcagcctctcaagtagctgagattacagtcatgcgacaccacaggcagctaatttttgtatttttagtagaggtggagtttcaccatgttggccaggctggtctcaaattcctgacctcaagtgatacgcctgccttagcctcccaaagtgctgggattacaggtatgagccacggtgcccagcctgtaatatatttcattccaacttttagatagcttctttatcaggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcagagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttactagacaaattctctaacctgtgtatttctaatacttgttatttgtttaatcttggctaggtcagcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctacttcgtgtgtgttgtttgaagaacttggtttctggcccaaagatgatgctttgtttacagtacctagaacagccctttggcgtatcgtagacactcaagaaattgtattcacagcataaacatgtttattgttgtggagtgattttctatgaaatgttacaaggaaaatatatattttaaaccaacaagtaatctttgcaaaaaaaattttgaataagaaaaatattgttctaagtaatctagatggagcatacacctagccttaaagagtctagaattgacatgttgggacattctcatatgttaagaccacattacaggttgaccagaaaactaggaagaaatagaccagatacttcctgctcaggcttttatgtgcatatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcttttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccaggatggtcttgatctcctgaccctgtgatctgcctgcctcagcctcccaaagtactgggattacaggcgtgagccactgcgcccggccagaaggtggagtgctattcttaactgtccttttgtagttctttgttctaagaatttggaaagacaagttagtcctgacttccatggaaatgttttttttccaaccaacatgggtgtaattctgaaggagaattctttcttaccagtgactcagtccctctgcagggcacagaatcaacagtattcctagtgtttgcaagatcagtgattatatagggtcagtataggcaaactctccatttccaatccgttgttaatgaaatgttatttttggtgaagttctgagatagactgaatctgagcagaataaaaaaaagtggaatcagcctgagttctagcttctacccctatttctgtgatatgcttccttattgacatgtgggctttgaaacttggtaacatccaaattgtattatcactctcttgaaaatgtcattgttccatgaaattgtgagacttaaccatttttattgatatctcagagaaaccaaatcttgagaactaagagcattggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaagtttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaagagatgtctcctatttattacagcactattatttatttatttattgcagcactgtatatttatttattgcagcactatttatttattgttaacactatttatggcagcactattcacaatagccaagatatagaatccacctaggtgtgcaagcatgaatgaataaagaaaatgtatgtatacagaatggcttactattcagccaccaaaaggaatgaaattctgtcattcacagcaatatggatgagtctggagggtatcatgttaagtgaaataagtagggcatagaaggataaatactgcatgtccttacttatatgtgagagctaacaaaagttgagctcatagtagtagagagtagaattgtggttattagaggctgtgagggggagggggaagaaaggagagggaacggttggttaaggaaaggagaggagaggttaagaggttggtgcagggttatagctgggcaagaagaatactttctagtgttatgtggcactgtagggttaaatacagctggagatgatttatttatattttcaaagatctgggggagaaggttttcaatattcgcaacacagagaaatgatgaatgtttgaggtgatagatacggtgattaccctgatttgatcattatgcattacatacatgtattgaaatatcactctgtatactataagtatgaataattatcatgtgtcaactaaaaataagagggaaaagtttcaaaacaatatctatttgttgattccatctgtatggcttagtgataatgtaatcttttgctgtcttgcattgttcccatactggatttcatgactaatatctttgcctttgactgatttgaataaaaatatgttaaatgaacagagaatcttgacctcctttcagaggctgaaggattccttaatttctttcctccatttgcttaggaatcagtgccattgactgtttgcttttagttaatacggttttgtttgcttaatacagaatatgtgcaatttaagtgtcatatgtacataataagatgtaatcttttaattatatgatatagcataattatttccattttatatatgacaaagttaatgtttaagaaagttaaataactctaattaggagtcaggattgagaatccagacacagatggctctgacatcagaatcactgctttaaaccactcttcttttctgcttgctttaatattcctttacttcctccataaagtgccacatcagaatatagaacaggttattaatggaagaaatatttcaatattttgagttttttgggtgaatgaaaattatagaattaaaagctgaacatcattttatttggcagtttcatcattatgatttaaaataaatgcagtttttgaagtttcctaatttattctcttgaaatatatttggattgccacatgctgtatattctaacacttggccctggtagggtttatttgtatatgtgtgggtgtactttaaatataaagatctcactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaatctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtatatttctttcagttatacacatacacataattaacatataattatatgaatttatatataattttgcattctaactttctatttgacataataacagtcttattttgcacttttatgattttccaatgagatatatctattagccatttctattttttgagttgcctgtttttttgtgtatgcatagatatatgtacgcctgtatatatacacgtatgcatacatatatatgttttttgttttataaaaagagataccatatttctattaataccgtcacagctctgatccttctttctattgtagagcttctatgcatgtattaaaatttaatttagaaccaatcaaggaagaggtcaatctgaataagataatatttgtaaagttcttgcctgtattatgtatagcaactagagctactttatccacagcgatttgaagccatgttgaacctatacaggttaattgatgcaattctcttggaaacatcgtcatctgttggcctataatgttttaaaaaccttggaacagtctcattgttttaagtatatctcctagttttttcctttaatttgtttgatgatatttttattttcttaagatcatcttcagctgaatcctgacaaccctactacatgatcataacaaaaaaagcaatgaggagtctctataccctttattttcataggaaaatattctaatatccacaaatgtgattaaaggatagagcaggtggtggggcgaggtaacatctgatgtgagaacgaagaagcaaacagttgttatttttactctggtcaggtgaaaacaagcagtcattacatgtctaaatcttgggtatctttggaatcattttcagccaccgtagtaagttgtacgtgcttgagtgtttttaaagcatgtcttatagtgaccaaatgtttctaccgcatttatctcagtaaagttgacaggattctattaggacgatcttcacctaatgagataaatattctaattgtaatcatcctcttggaatgcatatctcttctgggaattaaaagtgctttaagtggtgttgctaaacaaacatttctaaagagtaatcataaagttaaatgcctcacaatagcacaataggctttttagttgacctggtttttaatacttttttcattgcaaaatttcttattctggaaagtttggaaaaatgaggaaaaaaatagaaagaaaaatgtcgaatttaaacattttgtcactacctagttaaaatcggggataacattgtgatttagatttctccagtctcctttctttttttttttttttttttttgagatggagtctcgctccatctcccaggctggagtgcagtggtgcgatctcggttcactgcaagctccaccttccaggttcacgccattcacctgcctcagcctcccaagtagctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcttattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctattctcttttcttttgctataaattgtctgctacatcttttagttcataataattattgagtcattttctgtttaaatataaagtatttttctcatttgtcgctgtaacataatccatttttaagaagcagagcattttcttgacagagttttgaaatattgtgtgactttatggctagaacacagaaacattagttagaatttcagaatcatttgatcagctctggctttgagcctctgattctacttgtagtctccaaaccaatctttggtatccttctgtagagatgtaagttgttatcaccaactcaacatgaaattgtaagaatttataacagtgttttctaaaatgatttctttgatttattcaaagaaatattatctctgataatatatttcagtatttttcatattgctcaatatcagacgaaagttcttataaaagtcctgattgtttcagcagtgatttgcatgccattagcaggtcattcatccccttccactttgaggctcaagttctacactagatttgatttgttggagggagtctacaaactctgctttcactagaaagacatgatctgtgtgctttgctgccatagtgggcctatccacatggctcattctctgtaacactaacttccaggaaagctcttgtatcaaaattcatcaccggtattaaacagtgtcaattatttttatcacctgttgaaagcttaaatgccaacagaaatttgtgcttcacagggcattgggtcctccatttatatttttcaaatgtgtagtatactcttgcttttagtcgtctattacccagtgttcttttcggaaaatatttttaaagttaattatatactcacagataatagtgcaagcaagtttcctccatgttctgctttcctttttctgactttacttcatgctacattccttcacaaatagtaataagaatttatttctactcagaatgaatgttcctcacagtggagagaatttgccactacaaaatgccttctactctgtgtttaaattcctcgtacatacaagcaggttttgggtgttacatttgttcatagaggtatgaaattgagagtcatagattgaaatgttttttatagtagagactcccaaaaaaaggcacagaaaaatggttgatatctagtaggagttatttacatgctgctatttctgatgcttcctatttgtttcttctgaaaaagtcgcccttcctatgtctcaaaacagtacacctgtaaaaccacatcctactgggcataattctacaactgcttctattctcaatgcttgtgttgcatgcttttggaccctaagagaaatcagcaagctataaacccaggaccaagaagagcatatatctcttggaaaaatagcatttgagtgattgaataaaacaggctgttttggggatcattccaaatgcagggaacaatatggatctgtgatacttgagttgttggactttgtagaatatcaaagatgttctgcttttcatattcagatttttaaatagaaggaaataaacaatttttaaaatgtttggaattaaatgggggaggtcatctgtaactgtctttgttgatttttgtgggcatcatagcacagaagagttctcctggcttagcattctggtattgctcacatatcacctatatgctaatttgagagcgttcatgagtgccatgaaggatgagtcagaatgatagacagtatgctgactttttctcctcttattgaatttagtctgatctgctagtgagagaaataaaagggaaataaagcagggagtataatagggaaacctattttctccaaatgttgagatatttaaaaagtctttgttcagtgtacctgcagttataatctttccagagattcatgagatgtcagggctaggcaagactttagaattctatgtagtaaactcttgtttggggctgggaaaatggagggtcacagttagaataattgcctaaagccacaccgacagagagctggtagtggaatccctgttttctattcaccttcctactcagttgcactacaagtttatcctaattcaagtaagcttagacatcaccttgggtaactttctgatttaccaaatccactagtggaccatattgaatttgcttccaacatgaatactcttcatttctctccatccacactgctacccaccaaaatcccatgccttgaatgtaaataatcttagagctgatctgtttgcttctgtaacttcctgctactcattccataagcaacagaagaggcaaaatgaccttttaaaaagtataatttgatcattattctcctttacttaaaatcctagaatgacttccattgcacttaaaattccaaatttctttccatggcctaaagggtctacttgatcagtgtatcgcctttctctagaacttaatctacctctgacccttgtgtgctatgctgcagccactttggcctcctttcttttccccaaaattgaagacacatttccatctcagggcctaagtgtttgcagttagctctgtttggtgttctcttctcctagctgtttacagctttcagccttctgcagagatgttccccagctaccctgccgaatatcgcctttccccacccaatcctttcattaccctattttttcatagcagtaactactaattaattatgtctttatctattgtcttttcccagtctccaactagattgcaaagtccctgagggcagaggtcttgatgtcttttccattaacaatatctcgagtaaccaccagcaatctgcacatagtaataacctgaatattcctttaatgaatgaataaactgaaaaccctaaagttcagtaatactggcctctgtgtagagtttcagaaatatgccaaatatgctttcaagcatcccagcctgtctagtgtatcctttgctctcttggccttctgagatcacttttaattggcatcctctgaagttgttactctcagtcatgctggttgataccccgaatggataggaaatggataggcattttttctgtccatctctaaacatctctgattgggcctaatatacctctcaggcctgctcctctggccaggacccctctttttatgggaagtagggagacccaggaacacagaacctataatatattagaacctgttatatatctctctagaaaaaacagttattttaaggaacgtgattgctggggatggcaagtcagaagcctgtagggggaggcctgcaggctggaaactcaggtagcagttgatgctgctgttttgaagctgacttttttcttctatggaaagcctcagttattgctcttaaggcctgccaagcaatcggatgaggcacacccacattgaagattatctcctttacttgtggtcaactgattatagatgctaaccacatctaaaaaatgccttcatagcaacaccttgattagtgtatgattaaataatgggacatgatagcctagccaagttgatagaaaactacccatcccatcatgcatttgtggtattggagaaaggaaatgcttctccattgttactactgggactgttactgctgagacacaccgaagaggagaatttttagtttttagtttgctttttagcagaattcaaacttaaatataaaattaaccaaattgtcagaaaggactgaaggttatcctttcaattctgagttttttatgtaaaattattttattattagcaacaggttttgaaaacatttatcaattatattcttatatattggtgactttaggtaatgaataaatctggatttatctttctttataataaaaatatggtctgatcaaagtatataaaattgaaataaatattgtcttatttgtgctttaaattaattgtagtataatattaataggatattatataatattcagtcattttagaataggagaaacattttagggtaggataaacaagaccgtatcatgaaattggagattttaattgttttgtaatattaaattttacctctcatgaaaatagagtagataattattatggattatgaaacagcataattagttgtaacagttttaccttgaagaaaatatatcttttttataagcagaaaacttcattttgttttctttaaaatgaagtgaataccggccgggcgcggtggctcacgtctgtaatcccagcactttgggaggccgaggtgggcagatcatgaggtcaggagatggagaccatcctggcttacacggtgaaacgccgtgtctactaaaaatacaaaaagttagccaggtgtggtggcgggtgcctgtagtcccagccactcgggagtctgaggcaggagaatggcatgaaccctggaggcggagcttgcagtgagccgagattgcgccagggcactccagcctgggcaaccgagcgggactccgtctcaaaaaaaaaaaaaaaaaaagatgaagcgaataccatctctactctcaatgtatcgtggacgataataactatgctagtatttctgcatagtattcttaaagaattctgactgaaaatatttaaatgaaatacacataatcactttgccacctaatgcccatcaatcattgccaacattgacttttaataaagacacataaccagagatgatttttaaaaattatggataaattacattagaaaatttagctggagcaaattatatttgattattattaacctgccataatttatattcattaaattgccaaatcttgattataatagtcaaaaagaaaaggtacatgataatgatctagaggtagaacacatgctatcaactggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattaattatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctcaacctaataccctttcttctttgctaattcctggggaaaaggaatccttttcattttgatccaaatgaccattaatcatattataaagtgtaataattaaccctttttttaagtgtcagagacacatgaatagtgattttatttggtttcaataatcaagtaaattaagtgataaaatggaggccataattaagtgatcttgttttctaataagaccaacccattaatgtgcatgtaaagatgcctgtcatcaatttaacagctttctgagtttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgttaaatgccggccacattctgagtagacactttaacttggcttcccttgggaaataggaaatgaagggcccgaaagaactagaagctgcctctcaattttctttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcactatatgacaagtttagtgaaggcagggtctgtggctatcttgtttattattgttttatatcctgggggtatcacagtgcttgatcatagaaagggctcactaaatatttatggaaggaaagagaggaaagaagggagagtgaaagaaaaaacattcaatgttctcactcttaaaccaagaaaataattgtttactttatttcattgtagtaagaaaactgaacatgctactaccttcaataaatttttaagtctgcaatacagtattgttgaccataggaacaatattgtatagtggatttctagcatttgtctttcttaactgtaattttgtgcccgttgtttagtaactctaaattttcctcttcactcagaccctggcttccccccattccacaatttgattctgtgaatttgaatattttcatagaaaacattttatgagtagaattatgcagtatttgtttttctgtgactaacttatttcacttagcacaatgacctccaggttcatccatgttgttgtatatttcagaatttccttcttttttaaggctcaagagtattcgcgtgtgtgtgtgtgtgtgtgtgtgtgtgtatcacattttctttattcatctgttgatgaacatttagtttttttcacagtcttggctattgtgaatactgctgcaatggacatggatttttaagcgataaagaataaagctcttttcatcttttaactggaattattttttagaaaatattttgttccaattttatgatttttttgctattctttcatgattaaaagttatgtttcattattatcaggttgtatatttacatatatattttgtctgatgttaataatggcatgtttactttctttgtgtaagctgatgtatggaaaatattttcctagcttttatttcacattatttcatcttttgtttcaatcattcatcttgtatattttggcttccttcttcccttttactcaacttagaattttagagtgagtaacttttaagataaaacgagtttaacagataatttagcccattcacatttgttgtaattcatgatatttgtgtgtgtttgttatctcttcatttttgaattattttgctttttaatacatcttttctccatttcttctgcattaccttccttctttattattaattgaggttttttgtgctgttcttcttccatcttttttaaactaatgaattacaaaatttgcttctttttatgatttgtctcatagttattgttaaagttttgagacctgtgagtaaaaatattttatattaatacctagacttataaatcagtactaatatcttgtcttgaacaggacttcatccctagaatactttttatttctacatcatctgcttttaaataatcagatattaaatccagattgccatcgtttcatttttaaactttgcagcagagatttttttagatgtgaacataaggtgtctattttctttgcttcttgttattttgtgttgtctttctctttcttgggtaattttttgttttgttttgttgaatcagtaagcttttcagaaaatgcctgtaggtgttaaatttctgagcagttatatatctgaaaatatctttgctcttacatttggttaatactttggctagatttagaatttaaaattatgaaatgtttttctacagacttgtgaagacattcaatatttgtttcagcacatggccttagaaatgggatatctataccaatctaattcccatgtttctgtaagtaatatacctgtttttatcttctctgagatattttggaatttgctcattattcttggagttttgaaatgtcatcaaaatatgtctaagtgctggtcttgtttagtaatcttgtatacctcaggggaaatttcagtctaaagatgtatatcttttccttcagttttttttttctctctctctctccatatatatatatacacacacacacatatatatacacgtatatatacgtgtatatatatgtgtgtgtgtgtatatatatatactttttatgtcttattagacaaacgttaggatttctgtttctgttctctgtcttaacttttttatgctctccaggccatcatgtgcttgtcctataatctggaccaaacccaaggtacacatttgtagctcacaaattcttcactagtcaccatctctgacttatcctaaatgaaattttattttatttttaaagtgattatattttaaatgtttctttttataaaatgccaaccagtttttcttaatggctgtaatgtattgaatcccttaagctagttcattattcctatttcaagatttttttctactccttctattaattgtttttttttttttttttttttgagaactagttttgtgttgtttgcattggagtagcatatacaagccattgtttctgacccgagtgctctcttttagaattttttttttttttagggtcagatcccctcatctagtacctctgcctttaaccgcagtctcatgaatccaactgctattcagcaccttcgactcagatgtctgataggcctgtcaatcttgggagacccctagctgaacttccacagaaggatgggtctgctccttccctagtctccccatatcaggagatgatggtacccttcaccctgtagctcatgccaaccttggattcatcctgatacctttcttgtcctacattctacatccaatgtatgaacttgtgctcacttttatgtccaccttcaaacaaataccatatctgactgtctctcaccactccccagctacatccctaatccaagtcaccatcatctttcacttactctattgcagcagcaatagaccaatctgggctctgcttccattcttttcaccctatgtttattatgtattcagcggcctcagagaaatgtaaaacataaatcaagttccatcactccctgcaaacaacaacaataacaccccttataatggctttaagtcctaagcatgaccaatacagccatatgacatcaaggtcctgcttacttctctgactttctgttctataatttctataatgtctatcattgttcactgtgtttcagtcatattggtcttcttgctattttggggagtatgttcccacctcagggcctttgcacagctgtttcctcacctagtagctctttctctagatattacttggcttcctccctccctttaattgtttctcacacaaaatgcacctcctcagaaaaggattgctctcatccagttatcatccactgtccctctttatcccttttccctgccctttttcttaataacatgtaacgctgcctggtgtgaccaagataggtttgtttgtgtttgttgttgttcttcaaaatagaaacatgaccagggtatgggactgatgacttctccaccagcatatcctctgagggtgctgaatcatttctgttacatagtgggtgcagaggaaatatttgttacatgaggctatatatcaaagggcttcatgaaggttttgctttactgtgaatctggagtcagataattcttttctttatttctcctctgttttctttgtagagatcatgaatatcttaagctttatggtgcctctctctctatagtttggctatgagcctccccgaggcagatggttaactttatttagaaagagggtttcaggactttattctagtgataaataccgtggctgctagtcatagaataaacaagggcatgagagaaggcagccaactagaccagctgttcacaccatggtcctttcataattatcctggttactgcctcttggctgtgtgtattgcttgactccaagtgtggggtgtcttttgtagagctttatctggagctgttttagggagaatcaatctcacttctagtagatttctcctgtgtaagtgtgggctttgatttcctctacttctatttctactaagcccattacttatattaatcccatctactttcaaccttcaaggacttttatttttcaaatttctgatctgatagttaaaattttccccgatgtgccatgcacttattctaaaatatgatttttttcctggtgtcaataagatttggcgtacagggaaagacagatatatatgacttaaattttgtcttctttgcctctattgtatgttactgtttttatcttctgtgttgttgttgttgcttaacaaatgtagctacacatttatatcttatcactgttttcttaaaaataatttgttttgttcttctcccttttatatttagaaaatatataaaaaatgtggaccatgcctttgatcagaaattattatgaaaattgttgtttagaatgggtttgagggtggaaaagtttattaagagattgtaatttaacgaaagagaggtatgaatattctgagaattgaggtgtcttatgcattaattggattgctagatggccccactgatttcctgtttttcttgttgtgttaatctatatattgaattaagcacctcaaactatgagttattagatctcatatatctatatccctacagcaatttctctaagctctggtcatttctgctactttgtaatctaaaactgcttcataacttcctagatagaaatagaatatgtgggtgctcagagtatcagatagaccccatatataatagctatgaaatttcaggctctataatggattataggatatttttgaaccttggtaggttgtaggattagttgcttaaatacatagtaccatagattgcaaatgtttaaaaatcttgatgctggaatttattagaaaaacaggaatgaatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttccttttttctttcttccttcctccttcccttcctcctccccttcctcctccttccttttttatctcctctccttgcccatcccctttcctcccttcccatcccctcccatctcttccccttccctcccctcccctcgctgctcctctcttctcctctttctttctttgccatttcaggtgctttatctcttaagcactgcactgctttgggttatccatttaagcttagaaggagagcaacagaaaaggaattgaaatgtaaagcagatatcaagagagcaaaatttgtcattaaattggaactagcaattaatttgtctatttattcatagtctaagtgtgattatcaaaaatgcttgagaatcaatagaaccacatgggtttttcaagttggataggaccactgaagctacctggtggaaacacatcattgtattgatgagaagactgaagcaagaatatgaaaagcatctgaaccaatgttttcttttccacgttctcatcactctctgctacccacagctgcccgtcatggatatactatatgttgtcagctatattttgattacttctctgtatatttatcatcatagtttactaaaattgttagtattataccttttgcatataagaaaggatgaacatttctagttcttaaaatgtaagaataagtgattacatattaccttgaaacagtatggaacactttttactttaaaatatttttttcaatttttgtgggtacatagtaggtgtatgtatgtatggggtacatgtgatactttggtgcaggcatgcactacataataatcattttccagaaaattgggtatcagttgcctcaagcatttatcctttcaattaatgctcttagtctgttggtattaaaacaatttttattttctgatgagaaagttgctgtcactttgatcattgactttgctacaggaattttcttttcttttcttttcttttctttttttttttttttttgttttttgagacaggtctccctctgtcttccaggctggagagcagtggcacaatcatggcttactgcaatctcaacctcctgggatcaagtgactcccctgcctcaaccccctgaccctcactatctgggactacaggtgcacaccaccacgcctggctaaattttgtattttttgtcaagacaaggtttgtcatgttgtccaggctggtctcgaactcctcggctcaagtgatccacctgccttggcctcccagagtgcggggattataggtgtgagccatcatgcctggccaggaattttcttgaatgcttcaataactttattccatttaactctcacaacaatcccatcaaatcaagtatcatgattatgcctcatcattcatttcacaaattaataagcaaagtcttagggggttatcacttcccaaattattacatgccagtgaaaaaccaaagtttgagcttgcacacaaactttgaaacactattcaaaagcagtgttttcagcacctgatctttattgcctcacagagttttatacagatacaaaattatgaaatgtagctggagccaggaactatgacatggaatatacctggcatacacatggtctttgtcttttcctacatctgtgaacttgttgaagctttagatgtcttcccagctcagtgatcatgaagacgtcctcactgatgagtcatctttacttgtcatctctagctacctggaataaaacacccagtgtagtgtctgggatccagtgggcatcgtgggtcagttagttctccagccccggttccttttctggttgcctgagcttggaaaattcataaaatctctttggacctcagttacgcaactgtgaaattgtgctatagggtgacttgaaaccactttgtagattttttgggagagctaaattaggtaatgcatgtaaaagcatttagtgcaaggtctggcacataggatatatttgctaaatattcgtagaatcagatgaataactctcatgaaatattttgttaaacattgtgattgttcactgggaatattatatggctgtgtgtgccactgtccgtgtttcccctaataattaataaatattaaataatttaaaattaaatattaaataatttaaaattaaatattaaataattaataataaatattaataaatacctttggcaagtatatactatgtcttcaaaatgtttcttttccatttaatgttttcatttatctgcaacatttcttaaggcttatttgcatgtgggtaaaattcaggctacaataatagtcaaggaagtatatttctcttgttctgctcccatacaaatggtgcccccctgcaagcctcttctgaattattcctggacacccaaataaaaatggtaatttttctttccttttctcctggattcttattctaacatctgctaggaggatccacaccctgtcctaggctagtagtgtacagaccatggttttgatgtctgtgcaaaaggtacaggtttgtttgcatctcttcaatttttttcattgtatgaaaatataaataatataaaatgtactatttttaagtatacgattcactggtattaaatgcatctataatgttgtggaactatcaccagaatccattgccatagctcctttaatcttacaaaactgaaaagttgaactctttacccattaagcaataactccccattccccctcacttaagccccgggcaccactattctactgtctgtttttatgattttggctattcaaagtacttcatataagcggtatcatgcagtggtatctcatctttttgagactggcttatttcacttagcataatatcctcaaggttcatccatgttatagcatatttcagggtatttttcctttttaagactgaataatcatccatttatagatataccacattttgcttatccattcatccagccacgggtacttgggttgcttccactttttatctatcatgaataatgctataaacatgaatgtacagatatctctttgagtccctgctttcggttcttatgggtatataccccgaagtagattgctgcatcatataataattctgtgtttaaatttttgaggaatcaccatactgttttccacagcatctgtaccattttgcattcccaccaacaatatacaaatgttccaattcttcgcattctcgccaaaatttgttacatgttgttgcaaaagtaattgtggtttttgccattaaaagtagttacttttgcaccagcctagtatttttttttctgagtttttttttcttttgttagtaatgggtgtgagtggtatctcataatttttatttgtatttctatagttgttattgatgttaagcatcttttcatgtgcttaccagtcatttctgtatctcctttggagaagtatctgtgtattcagcgtttgcttattttcacattgaattatcagtattttttgttgttgaattttaggagttctctatatattctggatattaatttattgtcaggtacagatttggctttgatggcactaaagctacttcttcttaccttcgaagtcacagtacctgtaatgattgcttatgtttagcaaattaacatcattaggctttctctgtcattatataaccccttcatcctaagactcacacatgagcacctcaactgaggctggggatgtgtgtccctgttgttgggggaacacatgtccttagctctgactccctttctccagggtcatttctatcctctcttccgatgacggtctaccccacagatcctaagccacatccaagtcacctgaattccagcatgattcttacttagattcttaagtttaaatgcttgtaattccttcttcctttcctctccttattaagtacctttaaggaagtagaaaactctcaacatttagaaacacttacaagcatatgaatttccatattattaatgcctcgtgaccaagatgtcctgacacatttatatggtcctgtaaaagttttataaataatctggagcatattatttctttatatcctcactttgtgaactagacaaggtagatattaaaattccaagtctcaggaagtttgaatgatttttcttaagcttagtcagctaattaggagcagaatcaggactggaatttagggcttctggctccactttatctctgaggcttgtactattctactgggatatcattagaagaaatgccaaatgaatgccattgcctcttcagccctaaacacaaagcccagttaagtgtttccctgacatttttcctgacatctataaaaattcatattttatttttattcacatgctgattgatttagatgttatgaaaattaaataagttccaaaaggcagaagataggctatacacatatttttaaaaatttgtcattgttcaaacaatattgaatataaaattgaaatgtccctcattataaaaaaaaattctctaagagtgactagttataaggttatatcttttggcatgatgcacctctaagcagtgcttgcataaagtctctaccaaagctgacagagcttccctaaggcctaaagaacttggcaaatgttgttgaacaaaaatgacaacaatgaaactgtgtaggaggattctgcattagtgcacctaagaatgttctcgctaatttgagcacttctcaccatggaataatgcttttgttcctctctgtctttttctgctgtctcacagagactcctaacagggctccctggaccaggcttagacatcaatagggatggactagaggcattccatggaggtgacaattacagaagatcagaagtgcctagctacacactctattttcttctagcatctgaaattattgacttgaacccatttgtggggtcactaagccaccttcatataatatttattacatgtgcaaagtcagaacatatggagagcatttgcatttgaatgggggaaacatgctgttagataaattagaaaatctttatatttgcatttttctttatttaaaaaaatcaatctgtggtatagtagagctaggaatattccctttttggttgacttcttcactctgtgtttaaactttctcagcattgaggcatgtgattaaaaggagctattttcctaatacaaacaaaagcattgaacatcctgtgaaacaaaagttgttcattttaacttgcgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacctgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaaaagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcaccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacaggctgcggagctcaggaggtaatactcgctcacctgctgctcacctcctgctgtgtggcccggtccctaacaagaccattcaccggtaccagtcagtaagctgggagttggggacccgtgttccacatgttataaaaacttaggctgggcgcggtggctcacgcctgtaatcccagcactttgggaggtcgaggggggcagatcacgaggtcaggatatcgagaccatcctggctaacacggtgaaaccctgtctctactaaaaatacaaaaaaatagccgggcgtggtgggcgcctgtagtcccagctactcgggaggctgaggcgagagaatcacttgaactcgggaggcggaggttgcagtgagccgagatcgcgccactgcactccagcccgggcgacagagtgagacttcttctcaaaaacaaaacaaaacaaaaacttaaagagttatttgagccggacacagttgcatagacctgtagtccccagctacttggtgggctgaggcaggaggattgtttgagtccaggagttcgaggttgcagcgagctatgattgtgctacttacactccagcctgggtgacagagcaagtccctgcctctaaaaataaaataaattcggaaagaattatttggtgattcaagtataaaacaaaatctatcagatatttgtgaaaaacatattgttacattgttacatgttttaagaagggaattaaactcctagactctgtatggtataggagttcaacactataggttggtctatacatctaatgttggatatgtattttgtgccttttatttaaaataacatacattttatggcatttcttgctttgcattaattactggccatacccagaatcctttccttcgaataaaataacctcttttcccaaacttttacatattgttcatattttcaaccccctacacagttgttaggtcttgaatttggaagaattaaagggaataacattaatgacagtgaactatgaattaggaacctcaccctatcaatagccaatttccctccttttcagttttgtgtctcagtaatagtccttaaaacaacaaatgatacattaagtgacctgagccaatttcctcttgacatggaactattcaacaaagcctcacataagctaacatttcctaattagccccttaactgttgacttgagaaagggtttgcaatacaggattcttatatattaataaaaactataggtaaaaaattcaagatgttgttgaatctttacagttcgactcattattcaaattcttcatctttacatcaagtttctcatctttacattcctctaattcaggtcatctccacaatatgtccaataaaccgtatttgcaagatatcgggagaaaagcgagtctgcctctaggaattataactgatacttcctttgtgtgatgaacagtgatttttatgtatttagtcatatgctattagggaatagatatctctagatcagagaacagattgtgtattagtcacagaacatcttagcactagttcctccagccctagttcctgtggagtaacgcgatgagggccagatatctatccccatgggcagcagtgttgcaccgcatgagaggaaccctggaattatgaaacttggagcttacacagggcagctgggcacatctgcccttcctcccctccagagatagaaagacttgtatgtattctggcatgtaagcaaatgactctcggggagagtaaaaagatgcctccaggttttatttcatgagcatatggctccagaggagacgcatctctaaacctctcaggaacagttcattgtcttttacttctgagacatactgtccattcagtcattctttagccaaggttgccagtactctttgctaagaaaccccagatcatgcagaaatgtgaacatgttcacagagaattgtctctcaatcaatagtacctagtacattattatacaaagttctggggatgtttggcagggattgaacccatgaactagaattatgagcattggaacttatctaaaccaattagcaaataaaaaagttacacatttcttgagaaaataattttatagattaataattacatgtaggatatgcatatctcaagtcatctgagggtttaatgttttgtatactttatcttacaaaatagattccaattcatgctgtctggatatacaagcattaaggccttccaaaggcaaaatcaggctaggtgtgaaacatgagtggtatacggaggtatagcaagtagtgtcccttgatacccttggggaattggttccaggatgtcccagagataccaaaatccatggatgctctagtctctgatataaaatggcatagtatttgcatgtaatctagcccactttcctgtatactttatatcatctctatattagatataatgcataatacaatgtaactgctatgtaaatagttgttttatttgcattgtttagggaatatgacaagaaaaaagtttgtacatgttcaatacagatgcaatgttttggaatgttttggggcatatttttgaatccacagatgcaaaacccatacatataaagggctgactgtatttaagttcctcattctggtgtgattaattttatctctttttagtatacttgtggttctcaagtcactaatgttttagttataaggtgaaaggcacactgtgtaattgaatgctaaggccaattctttacctctgatgtctggaataagagccagatttcccatccttttatggaactacaagcgtcatggctattagcaatcccagaatagttctactcccactttggctgagtttaagatctttttctaaagacagtaaaaagagcatcagaaaagcatttgtgaggctgaagtacctcacataccaattttgtgggcacatttttggacccttaagttctttttgacagttttataaactcatgcccagagtagtttcctttatttaatatttgtcttaccctctacttacaggaaatgcaaggctcatcagctttttcagggagtagcatgactcagagtctgatgtacttgaaaaaaacacagcgggaatccaaacacacttatgtcatttttatgtgttagagagaaaccaggaagcatgaattctcacttttcttaacgtctttacagtgtcaaagggatatttgtgaaaagaggttgtgggaatcattgttctgaagtgcatccaagattagaagcctggtttatgtgtgctattttgcctcccagtatgagcagcctttttatatttattccaagtattactgtaaactactttttctttatacatacacaatatatctttgtctgtgatcagagcggagcttcatttccactgaccaatagaagggcatttttatttgatttaagtgaaacttggggcataatgcattctttcaaacctctgattggacatgacaaacaaaaagcttgagctagaccatggtcatctgaactatttccaataacttacctttgtaattggagtattgcctcaaatatttccctgaactctaattaccatggatacgatatcactcaacagaactttttcttaggagcactaagagtgtggaagacagaggataaatgttgtagtttcatttgattatctctatgtggatgctcacatttttttttctataaccaaccagtttcattttgatgagagtgtttggagagatggttatgctgacactagcctaggtaagagagtaagtctccctctcttaaaaaaaagtgacaatgtcacttctgctcacagtctgttgatcaaaatgaggcaaacggccaaacctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagatacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatattttcattggtacccaagaagccaacagaggaggccatgttttatgaattgatgtggctacaaatattagctctgacattttttaagtgaaaaatggcagaaaagatacagaagcaaataaatatagagtctctgacagccagcagagatggaaccctttctaacaattatgaccaaaggtatgtgtgtgtgtggtagtttggtttatacttgcttgaatgctgtccttgttcttttttttttttttttttttttttggtagttcttgcaccaagtgactgatggcttcctccaaaacaatgtcagcaggacaaggatgtattggcagggtatcttttgaatcagtaaccccatactgatccttgacctaattaacagtctgctataggcatcttgcagtttactgctactgctatcgcaacatcaagaaaatgttgaaacttaagcacccataagaaacttaagggggtgtcccactcaagtcattataaattcagttttattatgctaaaattgtgtgaactatagttcacacaattcaggctggctggaagcctgaatactacattgttttatattataccacatttattggaagagttggtttgcttttaaaggaatccatcactattagtttcatggcgtatttaacatctggtcaggtcagttcaatacttggaaatgttttgatacttgaagtttccagcagattttaacacatgcctttggatgtaagtaaacacctttgtccacaataaataaaatgtaactgagcaaatgaaactgtcacaatgctttgaaaactgtagcatactgaccaaatctatgccatgattttaccttctactgatggaaagaaaagtaactttgattattgcaatctgggcaattcacttatgttatcttatttaactttcatgaaaatcttcatatagtagctatcattattccatttcaaaatgggaacagaagcttaaaaatggaataatttaaagacatacaacctagaagaggcaaagcttctgaatacaacagctatctaactccaaaggtcttggttcttataagaatccattctgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcattttttatggctgcataggcctagaaaggtgcagaaactgctttcaattcctgaagggacttgtcaggcaaaataaacatactgaaaatagctttgaccatttctaaatcctttcctggatcagagttggaggttgctcctacattcatacgcattgctgatggattctcatcaatggcccctacttctgggttggctgagatcaataaatcttagcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagacatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataacgggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatcccagcactttagaaggccgaggcaggcaatcatgaggtcaagagatggagaccatcctggctaacatggtgaaaccccttctctactaaaaatacaaaaactagccgggtgtggtggcgggcacctgtagtcccagctactcgggaggctgaggcaggagaatggcatgaacccgggaggcgcagcttgcagtgagcggagatcgcaccactgcactccatcctgggtgacagagggagactccatctcaaaaaaaaaaaaaagtattttatacttaagtttttctagctgctagtttaagagagatgagaatacattcaaagagcagggaaaggagagtgtctgaacagaggaatttctaaaaatgagtacagtattaacacagttatccttacaatagcctgaggtcaggactattgttttctccacattttggatgaagggactgagacacagagaagttaagtaacttgtataagatagagaagagacagacatgaaactgttataaaaaggaaagagacaggaaaagaggagaggagagagaaagaacaaagcttggatggcaagttaacttaggtcatctacctttgaaattcaagtagtctgtaacttttgccattacatttagaggcaccctctgtgacacggtcatagaatactggttcactcttaggcattcaacaaatgcctattgagtgtcagtcatttattcaacaaacatttactgaatgtctaattaagtagcagatatagtgctagttacttgagctacattgcggagacagggcctctttgaagagcttgtgcttcctctccatgaatgctagattcatgctttccacctaaaccctacttttggaaatcaagaaaagttcacctccttcatgagacttcttggattaaccccatagtctattttcacctagaaatagaaccctgtttttgagtcatgcacgttgccagctgggataaaaggctacatttcctagtcttatacctaggtgaacccatgggtctcaggtcaatgggatgtaaataggatttgtatgagaattctgggacatcctccaagagagcagattcagctggcaggaaaggaatttgctttctgatatggtttggctgtgtccccacccaaatctctacttgaactgtagctcccgtaattgcaggagggacctggcaggaggtaattgaatcatgggggtgggtctttcctgtgctgttctcgtgatagtaaataagtctcacaagatctgatggttttgcaaaggggagttcccctacacatgctccctctttcctgtcgccatgtaagacatgcctttgctcctccttcgtcttccgccataattgtgaggcctccccagccatgtggaattgtgagtccattaatactcttttctttataaattaccaagtcttgggtatgtcttaattagcagcatgagaatggactaatacactttactacctatcctcctcctggcctggaataacatcactgggtgggtggagtttcagtcactgtcccaggacaggaggtggcctggagaatggaggccagtgcttaggtgtggagtagaagaatataaggggcttgcatccctgatgacctgaaggtcccatttcagccctcaaatagcctctttctggatttatttcatttgagagagaagcagttacatgaagtttgttactttgtttgagagataaatgcagttatattaggtttgttaattttgttttgtttttgttttagttgtatgatgctaaatccaattctaattgatatacctccttcataagataattttataaacccctggaaggaagattgttcattgggctttggcaggcagtgaccttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatatagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttccttagtgaggtgatcctctccttctttctctacaaagtaatgtggagtttggaatgaattctaatgagtgaataataggaagattttgcatactcatttggacaagataaacacaacagcatggttaaaattcttgagatgaaaggctgagtttctgtagcttgaattttagatgataaatatcaagaatctatttgaaggtcagctatcacaaatataatttttctctggcaacacttgggtagctttccttggcaaattttactcaaaaagaagataaattatttctgcctcaactttttcttttacctctcttcttctttctctttattcgattgtttgcctttgaaagtctggctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagagggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattccattttaaaatcacattgtctgtgatgtgtatttatggcattatctaccacatgtgtttgtcctgtagaatttacattacaaaaccttctctgatcaataattgacgatgagtgactgtagtagtttgggaaataacttgctttttactcttttgtcacctgcttcaatatagttcctgctgtttgatgagaattgactgagctggagcctgcaaaagtaactgtagtcaaattagttacattaaagggtcaaaattatagctgcgtggagctaaggtcatggcagaaccaaagagctctgggcacagatcttcctttcatgctcgactgggtccaataatcccccgaggctcaggtctctgattgcatttccagatggtctcctctggtgtaaacaccacccgcgctctgtccaacagcataagctaccctggcagaaagcaaaacagcaggtcagggagccctgggaattacacagtgggtggcacctgttgccaaattttgacctctctcatcccctacgttatatacccatgatattttcaacttacccctttcctttggtatttgcagggcaaactctctagtttcttagaataaagccagcttcatccactccccttcctaatctccatatattcttcaaactggtgcttagatttcctggctatcttgcagatgaattctaatatctactagtcagtagaatgcatttgtgtacttacacacttattattcaacaaatgcctattgagtgtcagtcatttattcaacaaacatttgctgaatgtctaattaagtagcagatacagtgctagttacttgagctacaatgcggagacagggcctctttgaagagcttgtgtttcctctccatgaatgctagtctcatgctttccacgtaaaccctgcttttgggaatcaagaaaagttcacctccttcatgagacttcttggattaacctctctcagatctgagcaggttgtccttctagaattgtcttaatgcatacatttgcagtcccttgtaaccttgttagactgcttctttcatgtagatgttttaaatttttcatagtgtgttgtgtacttgttcaaacgcaaactccccaagagagattcacttctggcaccttcatttttgcttttcatttcccctaatacattgctggacacttaattggtgttcaataaacatggtgaattcatttaacaaaagttattttgcacctaccatgctcacggctacaaatggacagcattatcacagcaactggacattacatagcatgcggaatggcagatggacagaccatatctataatatacttgggtaaaattttgaatgtttattagaatttcatccactgtctcatgtcttatagctacaagttaatttccaaatttgaatatgtccatacttgtttattaaaaagctggggacgatactctgtgagggtttctaaggagcatttgataaggtgtaaaaccactatagtcttggattcttctcattgctgagcagaatgggatgtgtcctgcagcaggttgagtggctctatgtggttttatgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaaatttcactgtacaccactttctcactaggctagaaatacatgaatggtggggcatagttcactccaaatctgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacacaagggaatgagttgttactagacagagaagaaaaagattgcttggcatgtcccaatttggttattgaaaatttttatttttgatgcagtgctcttcttttttccttccttccttccttccttccttccttccttccttccttccttccttccttccttccctccttccctccttccctccttccctccttctttccttctgtaacttaacacctatttgattttttgaaaacattttttattagatgcttagatcagctgggacaacttaaattgcaagctaccagaaatatcatattaaactaaccagtgaagatgacagtttggatcatggaggtagggttgatttcagctgaggtttgctttagcagttgcaacactgtgatcaagatctgccttctctccctccatttcaatctagtttcctggccttggctctattctcagcaggtcttgtcttcctgttcctaaattggccatgagcatctcattccttattctaatccaacagggattatacctgttggtatacctactcctcctacttcctcccttagtctgtgggggaaaaaaaaaagaaagaaaagaaaagaacttctgagcttcaatgtgattaggtcatatgcctatcactgaactgatccctgtggatagtgatgggattttgctgataagtctcagtctcagcccctcccccaataccaccatccactttacagctgtggcttcactcaacttcccttgaaacactgtatggagaggaatggatgcctaaatgacaacttgggtgtcattaccaagaaaaagggaactatatgcaagacagtcaaaaactaattaaatgtcctctctaaggtttcatttttaagatagcacagagtttgctgctgctcctcctctttcttcttttttttttttgagacagagtctcactctatcacccaggctggagtgcagtggcatgatcttggcttactgcaacatccgcctcctgagttcaagtgattctcctgcctcaccctcctgagcagctggtattacaggcacacaccaccatgcccggctaattttttttgtttttagtaaagagggggtttcaccatgttggccaggctggtcttcaacttttggcctcaagtgatctgcccccgttggcctcccaaagtgctgggattacaaatatgagccaccgtgcccagcccacattcttcttaaagggtttgagattttttttggaaattacagggcatatagctttgtgctttattcaaaatgtcatagagcttcaaacagttcttcctgagacagatgtaaaacaattttaagatttctgagaagtaatttatatatccttataatagtcataccatgtgaaacctggcctgctaataataagaagaaacatctggaactagtgacagggtcaattttgggtattctctctctatggagaggactagttcttctgagattgatgttggcagtttggaatcttttcccagtgggaaggaagacttagaagaggatagttgatattgcctctcctcccacaagcaagtttcatctttatcacagttccctatggctatgccattttgagatttgtatacaaaccctgtacattagtgagggactcactcagagaccacctagactccaatcagtatccagcctttaggagatggcttgacctgggcagcttccccagtgatggagtttacaaaggatgacaatgaccatattttaaatctgttgttactctcttgcaagactcctctttttctcttgcttgctcttcaccttagcacgtctgtacacacctgcctttggtataacttgaaagacagccctaattgaggcattcatctcatacaatccaagagtcaggaacacagcttttggaaggaatgcattgtggattcttcagatgtgatttaatgaatatccaactgtacttagggactaaaaagagcatttttaaatgagattttgctctgaattggaaagtaagttgaggtgggaaataagccagccattaaatgctctagttttttttttttttttttcttgagatggggtctcagtctcactctgttgcccaggctggagtgcagcagcatgatcatggctcactgcaacctccaactccccatgctcaggtgatcctcccacgtcagcctcccgagtagctggaactacaggcatgtgccactatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttaggttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaattgcaaacagtccaaattatatagtagtttctaatgtactttatcagggtgtcagtttttcttttgcaagtgttttgaggagatcagattgttaatgaacattctttgagaatctgaacctgagaactgtctctttaggatgaagttaccaaggacagatgcaaaatttgcaaagatacggtgttccagcctcctccaacaaaggttaacaaccacccgagaaccccagtgccacttacctaccacctcttacctttggaagcagattgcccagtgacggataagtgtggaaactgttcaaagattgggaaagaaaattgttagaaaaggcacatagagaagagtgggattgggggcaaaaggagaaggaggatagtcttctgtgtttttttgattggttaacttaaaatctcagctatttgtttacacaaaggctatgttgatgtccatattcaacagatacaggtatttggctcagaaaagcacatggttcccagaccatttgccaaatgtcctatccttgttcagctttggttattatgaatatccttctggaagcaactgacacctaacatgtctgaatcctctggacctgtagagttcttaccccggagtgattacaatttctgaaaagaacatccctgcaaaattagctttcaaaatacgtgcagataagcccatagaactgggaattcctccagggaattatatcctaagtagcctactacaatgcttgattccttgggcaccagtggttgctcaataggttttttaataataaaaactagaaggaaagaactattgttagctaaagttaccatgtaataattggcttgggtatgtccctgcttgtttgaattgcttaatgtctgttctttgcacagcagaaactcttgtgccacttcctgattagtcatcttggtcttctgtttcctgagctgtgctccatgatctcgtgtaaatatatacaatttgtgataaaatcatcttgctcattccatagcaggtataagtgggttaattctattgggaaacaagctcaaattttaacagaagtttttctttgcttcaagggaacgagtttcccaacagtgggaattttaagcattttggcaaatcaataggggagatattttcaaaccagcatgattctatttggctcaggtaaaagtaagcccttctggactggcttgcaggtgggttcttgagtcttggcttatttaaaaagctgctgcctgttcttaataaatgccatgatatgaggcaccatgaacaagctggatttaaacctgccctatcaataattttactcataagttcttggcaagtatgtttgttgtctgctgtctgcctgtcaaggttgtcagttagctaagcatcagccaaccacatgatgctgagtccccatgattaatctgacttggtaatactgttcatctatgtaaagaattggaaaaagtagatctcccttcatgcgtgtgcgcgcacgcgcgcacacacacacacacacacacacgcacaccaatttgtttaaaataaaaaaagattagacgaaagcataaaatcagccctctggtctgaagcaattaatctgtagaagatgctacatatgctgggtgtagtggctaatgcctgtaatctcagcagtttgggaagctgaggtggcaggatcacttgagctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaaaatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagcttattcctacattgttcttttttatgtcttcaaaatgggccttttgcatgtatgcatcaaagctattgacttgtattgattaacttgggcctcttctaaattttttcactttagaaaaaaaatattttagcaattggttattttatgttttccaaagacctaaatataaatgtacaggtgatgaactgcactttttcctttgaaatttgtatgcctttactttctttctctgatataattgtattcactatttcctccagaactagttaaactagagtagaaatttttggcatttttttggttcctaatcaaagttggaaaaacagacttttcccttgaaatgtagtgctggcatttaggttgagatagaaatatttcattatatgtttttaatcaagaatggatttgaatttcatcaaatactgtttaaacatctatgataataatttgaggtctccataggtttattaatatcataaatgaactattttagccttataactttaaaagccttattcttttaaagttttattcattctcctcccattcttgttcactattcgttgcccattcttgttctatataaaaaccccagtggtccctgctgtgaattcaatgacatcttatttcttttccttaagtcagagcaaatgtgcacatcagaagagcaaagtgtcaagtaatgatagctggaaattgagccacaaataaacagaaaatattttcttcattgttatttgtgtgtatgcttgtgcttctttttttcaagggagtagaccactgttccacatgttccacagttgttttatggtggaatgctctagttatggaaaaggagaatggagtctagccgtataaagttactaaacctgcttggatatgagtcaagggtatcctttttgtgcccaaactagaaaacctttccccttctcatatttttgagcaaggtgttttatgttgcaaagtagcccactgtctcttttcaactgcataagcccaaataacattttatattccagtcagtcacaaaatgaaaacaggaaacgtctttgaagcaaggcaaaaatgtcagagtgtctaaaacatagaagtacttggtgaaacactttcagcgtcttagctctgcctctggctagtcatttccactcgctgggctcagtcaggtctttcattagtgaaacagaggtggctgagcacttcctgtgaaatcgcagggacaggattgtggccctctggagagggggccaggaggaaaaggaaccagacagctggttttcgggagccaccagatgggagcaaatttccaaggctgctgagaagaatggtctagaataacagaattgttttgtgaaggagccttcctaaaccaaatgttctgagcgtccccgcaagcagagcaaatgagcacatactgtgttcatggggaaaaggacaaatgactgtacaaatggagtaacaaacaatttacgaaaatgtatgtggcctaaatttagtatcaaggtgatgggcaaaatgacttacaccaatttgtgacggtcctgttgcaaattcaatgacaaagccagccagtctacctagtccatagtatccagcagatatatcagtggagatggcccgagtgcaggctgcttaaataagataaatcatctgtgaagaaggaaaaggtcaaatgtgctattctctgtctttttttttttttttttggtctgaattaaatggaaaccattacaatttcttccaagaaaataaaaatcagcacctacaataatgctgtctccttctgaccctgccaagtctgactgcattccacctggaccctgcctttgtctctcatgtttttatccaagaataagtaggctaccttgtagtaaacaggaaatcttactcttacctcgcactagttagttatgcgtggtacttgatccataatcttctgcccccatgtcatagaagataggtttttccaactctcagatggaaaatcactagtgcactacacacacacgcactcatgctcagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctatacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttgtgataaagttttaaagttactatactttgcctgcctagaatgtagttggatctcaaaagaattactgagggttggaggtttgagtggcagaagagcaatgattgatgaaacagagttttgaaagatgagtggcctatttgtcatggaggtaggaatggggggtgggtgggcttctggagagacacagcagaagtgtagagaagaccatggtacttgtagggaacttctgtggtttagagtgagatggatcttgcaagagctcaggctggagactgagaaaatgctaagtcatggggggtcttacacaacattctagagaatttagactttcccctgtagacactgaggggccgtgaacagcatttgtacctctgcaagatttttctggcagagacatggaaaatggtttagaaggtgaagataaggagctcaattagtgggctatttaaagtgtgcaatccacagataaaaggcaaaaacaaaacctgaatcagaagagtataccagaaaagggtgccagcctattatatatggcaatttatgatttatttaacattgaaggaaaaaacaggccttcaaaaataataaaataagaaggtgctagctatttacccctataacttcaggtacaagaagaatatttttattttactgagctcctcaactgatttaaaaaattaatactcataccagattgtaaataattcaaggaatcatagccccttccttactttttttacatttgtaagatttaaagagtcatacacccagataacatcaggctgcagagttttagagaccaactccttcagtgatttttcaagatgagaatgttctccatgttctcctgcagaagcttctctgggagccccaatatgtacaagagacagaggtagaccactggctgtgccttccctcctcctcctccccattctactcagctctgaattgcagttgcatagtttgcaaacttaatgttgtcaaaccttgttattccataatgggggcatagttgtgcaaactggaagtgattgatttacccagggacagaagacttggttaatagtagaaaaggatccctaggttccctaattgttggacaattgctcttagcagttttggttaacctggtttttatctggcttctcagtagagatgattctttcataagatcacctgcacacaaccagctactcatatatttgcttatatgtgtcatatctgatttatgtacattttctgtagacaagcttgttttaggtcatgtacttattacttactaagtgtttgttttctccatacttggggatctaaattagtaagcaacaaactgacttggtgggttcaactcaataatatccaatgaagccatttcttcccattcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaagttttaccctctaatttcttgtggaccagcagctgtcttaattgacagtcccaccaaaccctggatttcataggatgtcccagacaatgagaaatggcttgaagatagaaaattgtctgtgtcttaaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcatatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgtggcttaacatttctccaattttcagctaatctactgagaaagtagtaattttttctgactagtggtggcctacttctcctataaggctgtcttttacaatgagggaagttggcctcactttatttataaaggtgcacctaaggctggtgctttctggttctggggctgcttaatccaccctctgtttcatttgatcctatagagtttgggggagggctgaacaacagtttcattgacgtgattcagattcaatttgctaagaacctgattgtgtttatgacattaataagaaacactttaagccttttaatacgaatccccagtcactctgcttcttccctttctactgatgatactttgtgatctacatagtttaaactttcattacacaaggaaacttctactaccacttgatgtgtgtgtgaataggctatggggaaaaaaaggttcatttttgtttgagttttttacttttcataggtcattgtcaatgtggtaagtatgctctttagtgggatgatccaacactagggcttcatattcaatatcatttacagaaatagtaaatgtcaataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctctgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctggtgcctcttactggcttgttaagttggcagatttttctccccatttgcttccttcattataaaattcccatttccattttgcctctaggtagaagctcatggaactcaaatgggaaatgatgatggtggattttcctgctgaaaagatgtacctcaaaaggaaaaaatagtgtatttaacatggagaaatgaaatcctccgaagggagcttcatgaactaaattacccagaatggccttactgtctgttgtcagcatttttctgctgcccctttgagcatcagtttactcactcatgtgtgggtcagctctactcatctgtgaaggtagataataaaacctacccccaaaaggttgcagtgaagattaagtgatgtcatatttttaaaaatgcctctgtaggctctggtacattccaatggcttggtgaatttttttttttccttttccttttccaaagggaattaaaaaaaaatgagagtgagttttgaggatcctagagcaagtaatcccagcactttgggaggatcatgaggtcagaagttcaagaccagcctggccaacatggtgaaaccacatctctactaacaatacaaaaattagctggatgtggtggcgggtgcctgtagtcccagctacttgggaggctgaggcaggagaatcattcaaacccgggaggcggaggttgcagtgagctgagatcacgccattgcactccagcctgggcgacagggtgagactccgtctcaaataaataaataaataaataaataaataaataaataaaacagcaaagcttctatgaattctccttttagcccttcatataagtctattcttcaggagccagtttatattttatggttagatacacatattaaattattggtatgtcagatatgattctattagtagtctccagggttcatagcttgttagggaaaatcctcctaaaaagaagttctttttgtctattcttcattaacttatttcacttgtaaagcattaaaatgggtcctctttacatattatgttgttttctaagggacaaatactagtggttattattacagttctttttttcatgtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagacatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattctggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataatagaaaaatcttgtttgcaaataactggaacataatgtacaatggaatgtgtcataaggggagtgcacacaatgctgtaggaattccaatgaaattcaccctcatctttcattgtattccctgttatttacctctccttaaaagaaagaactataagaactctacatcttttagtggcgatttcctagatagaaaaataatgaatattaaacatgatgtgttaggattggtgaggctgaagaaattctatgcattttgtcatttagtgaatatgtattgactgcctgcctattcagtgtcaagcactataggtggtaatgtatcaagaggttcatgaactaataataaaggggcacctctgtatttcacaaatatttgctgaatgaatgaactcattatattttattctcctatgtgattcctagataagttctgctacctaaaggaaagcacttatggaatccaaggtttggaaagggcttgaaagatcacattaataggtttcccttttatttgcctttttgaatctcaatatggaataactttgacttatccatactaaattgcatctcattggtgttacacaatctttccagtttttcaagattatttttaacttatgccaacaacatattaaatatcctttccatctatgggacccattccattttctaagtttacctaagactttaaaagacattaagccatcagagccaaaaacagagtttctctacttccatgttgatattctccttaatctacacttccattcattcaataaatatttactttcagggtgttcggatgagctatgggttacatagtgatgaattcagcagacatagcttctgccctcatgaagcttacagcctacaactacagaggatggggctgttgaagcagctaaaaaaccctaccttttctactattgagcaataaaagaaatgtttttcttgaatttctgagatcatttcttgccagtctttgctcatgtcactacctggaataaactcccttttatcatattgggttatcaacatcttatacattcacaaaagaccacataaatgttaccagctgcaaaaatcttattcatgtctgtgaaatccattaacatgtggcaccacttgagttgggctcatcacttgctgatttctgctgtcattatttgtgaatgtctaatttcactgtaagctcatactgtcctttcaaacatgaatgaggcctttaacattgttgtatcaatccataacattgaacataataccctgtttgaggaggcatgactatagaccctttctgtccaataataaagatgttggtaagagtaaataaaaggtctcatttcttgataaactggttagaatcaaggaggtctgagcatgacactagggttcctaaatactttcattctagacacataaaacctctagaagattaaattcagacaattttaaactttagatacacattacaacacaaagaaatgcactattataaattttaatgggggaaggccggtaattcaggaaactgtcagatctgaataatgaaataccagatagttcttatctatttacatactctgtgatttctaacactctgaacaataatatttcagggttctaaatattggttagatttttaaagttttcgaaattatataactagatgactgctctcaaaattaggccggtattttggattacacagagtgcctaaaagtgcatttttcctcctgaaggggaaagccatgtgcctagccaatattttcattccctaaggatccatggaattatgatagcttaccctcatcagtcacccaggctcccattggtgtgaattgggcaatgctgtttacatagcaaatacacttccttttatacaagggtccacaacccctgggccatggaccagtatcagttcacggtctgttaggaactgggtcacgcagcaggaggcgagctgcaggtgagtgagcaaagcttcttctgtacctacagccactctccattacttgcatcaccatctgagccctgcttcctgtcagatcagcagcagcagcaaattctcatagaagcatgaaccctattatgaactgcacatgcaagggatctaggttgcacattccttatgagaatctaattgctgatgatctgtcactgtctcccatcacccccagatgggaccaactagttgcaggaaaacaagctcagggctcccactgattctacattacggtgagttgtacaatcacttcattatatatcacaatgtaataataatataattgaagtgcataatatacataatgcacttaaatcatctccaaaccatcccccactgccaccctggagcatggaaaaattatcttccacgaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcatccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatgtcaagatatcgtgagcactagtgcttttaggagagaatatttaactcatttcagacaacatatattaacttcatcaaaagtttgcctgttataaacctgtgactcactcttggtcaccatgatggtgcaacagctgtccactggacaaatactaaataatattttatccttgccccctatttcttatgagaaagccacaatgaacttccttttgtctctcatttcacccttaaagggacaaatagcattgcattatccttgaaagggtcttctgctgacccatctttgacgcttccatcacagggtgacgatgggatgtttgctgtatcacacttccctgtgctttcatgaatgtgttactggtgatgaagaatgccaattctttgtttagtagcagtttgctgggtctccctgaaaataatgtgtcagttaggctacctataaatctgagtcagtaatgtacttctctaaggtatatttatgttttgaatttgtctctgagcaatctgttggggggaaattttgctttaatatgttttataaaaaggtgagaaagtaataaagtgtaatgaagataagataaattttctaataaaataaaatatagaagtgttcaaaatttttgctttccccatatgactttgttttttccccaaatgttaccctcataacaggtgggttctgtctcttgatgggtatcaacacagtgaccacaaccgaggaggatttagcaagggaatcttactacttgtaacaaataagggaaacaccaggagcaattcccaaagcagtatctctccaagctggggggcagtcagattttataagtgtagggtaataaggtgtgatctgattggattctgcaatgaggtgttgtcagaaggcataatctgactggattttgccatgggatgatggcagagctcaatctgtttggatcctggatcctgccattgttgtgtctgcttttaattcagtccctactccttggtcagagcacttaggttccccctgtggttgcactcttggttcttccgcacatggtcaggttatgtgacctgagggtccatggcaactgaaaaacaagaggaactttgttacataaaaaattgaaccagatttgcctggcatggctacacaaatggatgtctctgttcagccttatttatccacagtttttcctcctgctgatccctttttcttgcctgtcctccctgcctgctcacttgctttctggcctctcttgcctctcttcttagccagagctgtatagggatttagttcagtgtttcctccttcattgtcattggacaatattcactcatcagctccaggtcacctccctgtcctcacctgtgaccagtcttccttccaggttcattgccattttcaaagtgagtctgcactctctcaccacccgtttgcttatcacccactctctatgtgattacttgtgatttgacatctgcccatgctactacaatgaaatggctttctcagagactatcatatgtctctattgacaaaaccggattagtgctgcttattttctgcagtatttactgttgttggacaccgcttccttcaactttctcctctcttggttccagggcactatactaactttggtggccatatactcagtgcctccttatacatgagtggaagtaaggggttcagaatgaaatgattcagtcagtctcataaagagataggacatctgtggagattaaagttctcagagttagtagtctcattgctttattccacatgatgttgacaaagaagtagaaagggaaagccaaatccttcaatctatattgctaattaaaaaatgattttcttttcttctttttagtaaatgtttgatggtgtcttgggagtagccttagtagcaaaaggaaatatttatgcatgtctttgggaaaatgtctttccattttctgtggttattgtatctgtaaaaattggacaccatttcttaaaaggattatgtgaaaattttatgatgcctggttggtgaaaggcagagtgtcctgaaatatctaaaatgtagaatcatattctttctattgttttgatataattagaagtgtcgattttaaaattacactgaaaggcattttatttttaacattgttttattaggtgagtgcaaaagtaattgcagtttttgcattgttgaaatttgccatttgatatgggaatacattcttatttttaattaattaatttattattattatactttaagttttagggtacatgtgcacaatgttcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcagtgtctggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacaccaacttccacaatggttgaactagtttacagtcccaccaacagtgtaaaattgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcacgtcctacgcccacttcttgatggggttgtttgtttttttcttgtaaatttgtttgagttcattgtagattctggatattagccctatgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttcatggctttaggtctaacatttaagtctttaatccatcttggattgatttttgtataaggtgtaaggaagggatccagtttcagctttctacatatggctagccagttttcccagcaccatttattaaatagagaatcctttccccattgcttgtttttcctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagtttttttcaattctgtgaagaaagtcattgatagcttgatggggatgtcattgaatctgtacattaccttaggcagtaaggtcattttcacgatattgattcttcctacccatgagcatggaatgttcttccatttgtttgtatcctcttttatttccttgagcagtggtttgtagttctccttgaataggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaatagtagtggtgagagagggcatccctgtcttgtgccagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttttatgctggattacatttattgatttgcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcggctgtgaatccatctggtcctggactctttttggttggtaagctattgattactgccacaatttcagatcctgttattggtctactcagagattcaacttcttcctggtttagtcttgggagagtgtatgtgtccagaaatttatccatttcttctagatttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttcttctctgatcttagttatttcttgccttctgctagcttttgaatgtgtttgctcttgcttttctagttcctttaattgtgatgttagggtgttaattttggatctttcctcctttctcttgtgggcatttagtgctataaatttccctctacacactgctttgaatgcatcccagagattctggtatgttgtgtctttgttctcgttggtttcaaagaacatctttatttctgccttcgtttcgttatgtacccagtagtcattcaggagcaggttgttcagtttccatgtagctgagcggttttgagtgagattcttaatcctgagttctagtttgattgcactgtgatctgagagatagtttgttataatttctgttcttttacatttgctgaggagagctttacctccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttaacagtggggtgttaaagtctcccattaacaatgtgtgggagtctaagtctctttgtaggtcactcaggacttgcattatgaatctgggggctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgtttcccatttgcttggtagatcttcctccatccttttattttgagcctatgtgtgtctctgcacgtgagatgggtttcctgaatacagcacactgatgggtcttgactttttatccagtttgccagtctgtgtcttttaattggagcatttagtccatttacatttaaagttaatattgttatgtgtgaatttgatcctgtccttatgatgttagctggttattttgctccttagttgatgcagtttcttcctagtatcgatggtctttacattttggcatgattttgcagcggctggtaccggttgttccttttcatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggagttgctcttctggaggagtatctttgtggcgttctctgtatttcctgaatctgaatgttggcctgccttgctagattggggaagttctcctggataatatcctgcagagtattttccaacttggttccattctccccgtcactttcaggtacaccaatcagacatagatttggtcttttcacatagtcccatatttcttggaggctttgctcatttctttttattcttttttctctaaacttcccttcttgcttcatttcattcatttcatcttccatcgctgataccctttcttccagttgattgcattggctcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctccgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcacttctgttggagtacccggccgtgtgaggtgtcagtctgcccctgctgggggatgcctcccagttaggctgctcgggggtcaggtgtcagggacccacttgaggaggcagtctgcccattctcagatctccagctgcgtgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagttccagcttcccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcaggtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatgcagaaatcacccgtcttctgcgtcgctcacactgggagctgtagaccagagctgttcctattcggccatcttggcttcaagagcgggaatacattcttacatgtggttatgttatacatcattttaataggtatttctcacttgtttttgctaatgacttactacttgctgtttattttatttttattttagactatgaaagtgatgttagataaaaagcaaattcaagcaatttccttattgtagttcaaaatgggtcataaagcaatggaggcaactcacaacatcaacaacaaatttggcccaggaactaacgaacatacagtgtagtggtgattcaagaagttttgcaaaggagatgagagccttgaagatgaggagtgtagtggctggctcttggaagttgacaacaaccagttgagagcaatcttgaagcttatcctcttaaaactacaagtgaagggccaggcatggtggctcacgcctgtaatcccagcactttgggaggccgaggcgggcagatcatgaggtcaggagatcgagatcatcctggctaacacagtgaaaccctgtctgtactaaaaatataaaaaattagtcgggcatggtggcaggcgcctgtagtcccagctactcgggaggctgaggcaggagaatggcgtgaaactgggaggtggagcttgcaatgagctgagatggcgccactgcactccatcctgggcaacagagtgagactccgtctcaaaaaaaaaaaaacaagtgaagttgccgaagaactcaacgttgaccattctatgatcgttcgacatttgaagaaaattggaaaggtgaaaaagcttgataagtggatgcctcatgagctgagagaaaattaaaaaatcattattttgaagggtggttttctcttattctgtgcagcaacaacaacaaacaatttctcaatcagattgttacttgtgaggaaaagtggattttatatgacaactggtgatgaccagctcagtggttggaccaagaagaagctccaaagaacttcccaaagccaaacttacaccaaaaaaatgttcatggtcactgcttggtggtctgctgctggtctgatccactacagctttctgaatcctggctgaacaattacatctgggaaggatgttcagcaaatcagtgcgatgtagtgaaaactgcaacacctgcagccagcattgttcaacagaaggggctcaattctccaggacaacgcccgactgcatgttgcacaaccaacacttcagaagttgaatgcattgggttacgaagttttgcctcatttgccatattcacctgatctctcgcgaactgactcccacttcctcaagcatcttgataacttactgcagggaaaatgcttccacaaccagcaggatgcaggaaatactttccaggagttcatcaaatcctgaagtatagatttttatgctacagaaataaacaaacttatttctcattggcaaaaaagtgttgattgtaacggttcttattttgattaataaagatgtgtttgaccctagttataaaatgatttaaaattcatgatctaaaaccgcaattacttttgcatcaaccttaatatttgaaaattagtaaaattgcaaaaagaaagcccttattagctgttaataaatataaaatatataaaatgtgtgtgtgttaaactaagtgccttgagtatatgaagctatgaaaatgaagacaacagccttactaacattccatctcattattgttataactcctggttccatcataatcttgtttttccatcccaacagaatctgaggtgcagtcatttttgtgaagctgttattttcatcacaatgtgatctatacctaatgattacattacctgtacatctgaagctcgttcgtaaaccatcgtcccctgagagtatacctaacataggaaatactatatatatttggccgctgaagtgctataatgatgccctaaattacatatccctttctacagacataatttgctttattaaaaataacttctgcataactattgaagaataaaacagccacttatgcacaaggtgagggatatctgcatatctgagctagacaaaaagtatgtttgataatctattgtatgttttgctacaaaagcaaagtggttccttatgattggctgaaactctttgagttcttgttctatctttcagcaaatgaagatgctaattgtctttattctagccttttataacattaccttggctcttcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaaggttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgattaatctattctgagttccttaaatgctattgtaacaatgtcaggggccaagttcaagtctaaagtacgtgtatgatgatcatagctgctataatactcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatttgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctaggtaatttaaggcaaagatcactttcaaaagccagatttatatatttttccctcctccattcaaataattgtctcagagtcccatttcaacttattttaatagttacttcctgcatatctgtgatgggttctcaaaaactttcaaaaccactttcacatattccgttacttagcccttaacaacagtgtcgaatagggtaggagagaaacattgttccctgtttttcatttagaaagccgagattcagagaggttaaatgactgtttctactccacaaaaagaaagaaatcagttgaattttctctgataaacctgccaacgttagtgatacgaaagtgaccacaccgatagagtggtgtcactgtcaatattattctgttggcaaacatattgtatctggaagtcaagggcaagaaaagaaagttagaaattgctgagataagggctgtgctaccgaaaaaacactgaaagggtgccccagctagggtctcaaacctatacctctccccttcagcctggtacttcaatactgagtagattatggtgcccattttgagggaaggctagtgttatctcattcagattaagttttgtgttggtgtgacacagatgggtttatataattaatgtcatgtcctagagggctgtgaacattcctacacttgaggcagtgttcaaaatctattactgtttttttttaattaaaaaagaatttgttttctttttcccctagatggaacttaaactcattgtatatgattgaagaggaacaaggagaaggagaaggagagaaacaacatacaataaagttgtccaccaattgtcccaggaaaatttgtttctcacataggggtcatcacaactgctgcattgcagtcagctggaagtataatcttccatgaatctgaagatgtgatgaaagatagtaggcacaggcaaagcctagctttaagaaaaacataaaatgaggactttgagaccctagggcctctttccttcttcttccccttgataggcaaaggcttttttccaaatcatctttgtaagaagtcccagacccacaatgaactattgaaataccatgatccagtaatgtcatcttcttctgctattaatatggtaatcattttaggtgatagatttcaccttcaacagttcttgaagaacattcagacagttcaccctgaaatgggtgaaaaaaaatcaggtacctcctatttcataaggatgtgagccaggatgaagcagtatgttatcaggcttggcatttcgcaagctgagtagagtccatgtgatcaccaggtataatgttatgctggagttgggtttcatctcttgcttgggtttggaatgtaaacaatcttgaaattgtatttggagagaaggaaaccctgggaaatgtttatttttaaaaaacatggattttttacaaaagcaaatacatgttctaatttacatcagggagcagatacctctttacttttttgagatttttctgagacattaaccttaagttatcacttgtgtgtatcaggagaaaagttgggagagtgggagagatgggtaaggaaacatttttaaatgtacttaaatctcccatgatttatttcaagctgtaaagcatttctaaaactcgagtttgttaattatcccaaggaaaaagaagagaggaaaatagtcaatctgatagactggtgacattccatgtagcctgatactaagttgtgacaaaatatctaacattcggccattgtttttgatatttgtactttttcttgtaaactatttgctctgggacaaaaagtcattggttttgaacttgatttgggcaactaaatgatatacttaaccacctgctttagcccgaccatgactttttaatgacttccattttatttggttttggaaattgatttgccctttaaaaataatatcagcatttaaagtaattttgcttgttttttgtttgtgtagtagctaaatatgctaagagaatgacttcaaatatgcagcctttatgaagatgtgaaaattgctgtgctctagctacaaatggcaattccgataacaagagcttgaatgtggccttgaggcaagggaaaaacagaaaaagtccactgaaagtcaactttgtccccttaatttgcaggcactgtggggagcagggaatactccatgggcacaggcatcctcccgagccatattggttgtagtgttgtctattatatctgcacagttcctcctttgattctttctatgaatcatgtgttagcaacccaagtagctgccattagctccagccatatgggtgaaggtaggggtagaggttgcagagcttaaacataggtatccagaaatcattggctcttcccatttcctgactgattctccaactatcaatctgcttgtaagcacattcacaccactcagtgcccctggtacataaaacaagagcagtgactgaaataagctctcaaactagcaaactgaacaagctatacaagacttcttggatattgaaaatactaaacattctcatagctatagaattaattatttggaagatattggcaagtaccttttcatgtctacagtgtccatctattaaatgggaactactactctgaaagtagcagtaagttttattaggggaagggggagaatcatcacaatcatctaaaactgttttgtttaatgttacctgccaagatatgtgtctaagaggctgctgtggctcccaccagccctgacctctgcacatcactgaacctgtatcctactgttaatgatacatatgtcatatttacaaatgcctcatgtgtctcagggtggtaaaaatgtttctattcaagaatggcaactaaaaacacccataggtccatcatattggattaaccacttatatccagctacctgaaactactggcactactcagaaaataaattttcttttaccatcttgcccacttaccgttctcagaaagtcctgcctttcctttcccttctttatccaattaacccaacttttagctcttacatcaaatcttctggaaagccttctagacatttctctcccttcctctctgccattatttctttttcaggataggttagatattatactgggcgctctcatagcttcatgggcatacccatgtcaaagtagccagcaatcgctattctaagaaacttgtctgaatttgtaattggattgtaaatatcttgagtgcaagatcttcaacttgtatagttgtatttccaattttcaacatatgttgagtgaatgtattctaaatataatattaagcatggcctatacctggtaatataaacatggaaatagaatgattatttaatttgtcatgtctgtgaaggacccttgatggtatctagtcttaaccctcaacttacagttgaggaagctgaggaccatagtgtattcattcattttttgtttattaattcatgaattcattcatgcaacacattgcattgagcatccatgtgtgcttggcactgagctagccactgaccaggtaatgctaagtagagcagaacaaaagacatggtccttccctcatagagcttacctcttagtgcagtagagacacagtaatccaatcatcacacaagacatttatactcaccaactgtgctaactggggactatggcagccaactgatgtgaagatttggcttaatggcaggagtcaggaagcctttcctccaaggtgtggtgtttgaactgaaatctgaagaaccagcagaagagcacaaggagggaaaggagtttgccaggcccaggccagtgggtttgaagccttgaggcaggggggaatgaggtgcattcaagaaactgaaaggcggaaagtgcaggagcagaagaatgagggactcaagaagaaagaggcagtacaaaataagaatgaaagatggtcaggggccagttctgtaggacctgtagccatttaaaaatgtttagttattaacttagaacagtgagagcactgaaatgtgtgagggtcagaagaactgggaggtggcctgataacacatgcattttgaagaatctctgctgcagtgtagagagcagattggtggacaattgatggactgagcagataggtgagaggtagccctactgggaagaatatgctgaagtgtgtgcaagagattttggcagcctggagagtagagagcaccactgacctctctgttttttctaactttctcaaaaatgctacgttcacctacatcttatcaaagaaggcctttatttacctatacttctagcatgctttgctttagattttcccatttctcaggtaagggcacagaggctaacgaacgctcctttcctggggccaaagcgttttcagtttgggcatctcagtaacttttggcaccactgctggctttaaggagcctgttatgtagtctatggtggatctgaataccaggcagacagatgacatttttataaatagtgtgaggaaaccccagaagtaatgtgaatggatgagagttcaagaccactgctgacctggaaagccaatgactgaggcaccagaggaagtaggctctcagagggaagacagaacaccccctttccagctcattgagagtgaagcaggtgcttttctgaagcaggtgatattctgaagatccacctcctcagaacaagtgttctgaagtttctctgaaatgcagagaatctaccatatgatatggttttgctgtgttcccacccaagtctcatcttgaattgtacttcccataatctccatgtgtcatgggagagaccttgtaggaggtaatttcatcatggggggcagttacctccatgctgttcttgtgatagtgagtgagttatcatgacatctgatggttttttataacagggttttcctcctttgctcggcacttcttcctgccgccatgtgaagaaagatgtgtttgctcccccttctgccacaattgtaagtttcctgaggcctctctagccctgtggaactgtgagtcaattaaacctctttccattataaattacccagtctcaggtatttcttcatagtagcatgagagcagactaatacaccatctgtaagaaacttggaaaaatgatttgtttagagttccatctgagcagtcatattattagtaagatatatatgtcgggaaaagaaatttacttcttatgactttttacattttgagatcttattgtttgatgctccacgttgagggagccatatttctccacctggtcaccaggctcattaggagggacagatgtggcctcacatttcatgtgcggttcttgtctcagcccttctttttctcaaagattcctgccttttgtctacttttctcaaagtgccatcttccttctctcaggctcttttgggattacccaaccaccattgtaggcaactctagttctataggcaactctagttctataggtaactctagttcagtatcatgactttcatggtttctataaaaattgccatcccacagccttcttcacatctgtgacaggcagttgagaggggactgaggaaaagtattgcccatacatggaatttgtggagactcaatcaatgttacttggattgagtaataaaggaagttatttgtctaagtttgggcagcaagagaatggcagggacagaaccaaaagcagtttttaaacgataatctttttttatttttttactattaaatacagcttgggggcaaagaagagggatacaatttgttgactttcattgctacatttttggacaaggaaagagaaacagagactcaggactgtttagaagtccaaatgctatttatttccccatactacaatggctgttgaaaattctcctataatatgctacaaatacaagtgtattagagagtttattgtgtatatttttgaacatagtgtaatttcttgtatgatgttaatacagttcttgttcttattctctgtaagagcttgtgttgctgttatctctagataggagcaaacttcataaaatgtagaattccctctgcatgcatagggaagtagcttttaaaatattagcctattccattgtttagttataaagtaaaatgattttttaaagtgcaggataagtgaatttttatgtttcatttttagttattgaattgtctaggtaatgcattttaggagggcactgttcctcccagaacttaggaaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacatggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttattattattaatttggtttaagggttttgcctaacaagtaactcccttgatttgtatgtttcagagttgtttaatttttctccaaaataacaatttgtccttttgaaattctttgttagatttatgtcattccagtttcaatcttggtgatgattcttctatctgtcatgagtggtttaatctgcatgtttataattatagcatataaagccacataattcaaggtgggtcttggtatataattcctttgtactttttgggaaaataaggctgtaatggaagtaataaagatacctgagttgggaatgtttaggtatcaccaaatattagctgttcagaaaaatatccatgataaattagaaactgaaatcagcacatttttctggtttcggttcttttggggaaacactgttattttttaattcctggcttaagaattgtatttgattatgcgaagacaaatccaaaattttaaattctaatccaagaccttagataaattagggaattagggaatctgtgtatgtattttataaccatatcaccatatattgacatacctatgtcactgaaggtatattgtaaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctaccatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaagtcaacaactgagggaaacatccctgaggaaatgcataatggaagtgctggtgtaactacctcaaataaatatttctactgaaactgatcagtcatccatttgatcaggtaaggcaggcaagcccacctctgattgcgtagtaattcactgatcattatcctgatttcagtggatctatgccatactcaagacctacatttgtcagtgacctgattgtcttattgccctacacagacatataatcagtccagcctgtgtgaaactccttgtgacccttatcatcatacttaagctgttttggtctttcaaatgtattcgctcttctttaccattttgaagccatcactctttcaccactgccagctagtcttagtaatctttcaccgtgcactgtctgttgcctcactgaatcctcacagtcattctatggcataggtaatatgattgtcattgacattatgttcataagggatccaaggttcagagggattgtattgttcagggttgcacagctaatttctagtaaagccaggaatcaacttgcgtctatatgattccatggtctatgcacttagctgtgatgtatgcgttctatctcaagtgatcacctctaaaatcaggatcagttcacagatatttgtgagtctctcaagagaactagggaaacttctgtaaagttagctaatggctttttaatgttatgtggtaattgtggtgaagcaattgtcaattccagttaaattagcttaaaatgataagagcaaacacatatctttgatgataaggctgggatagaggttaatgtctcatcaattttgggtctctcttagatgtttgaccttatcctaacaacttaagctttaggtaaagtctgcatttggtactctaatctcttcctatcagacacaggtgctcttctctgcccaactgcaattcagtccaagacatgccttctccagttagtctctggagaatgttgttcctacttagactcactgcatagatcttaacttgtactcctgctggtggtgtgcatatatgagctgtcacttgaccatgcagccacacctggagacccatttctaggttcagagtcatctctgatgcagcctgtaatttccccactagcatgccactctgtaggaatgaaccagacattgccacatcattctatgtagcattttcttaaaattagagcttcactataaacaatctttggtcaaggaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcagaaaataagtgggaaaataacaagatcctaggaaatctgttgtatggagctgaggaaaaggaatgagtttaggtttttctttaagttattgaagaaggcatgggattatcttctggttgctagtcttcccttagtttcaatgggaaacttatcagacacacttatcttgcagaagcaagataagaggacaaaagaatttggaagatcatggtggaattaaaaaaaaaggaatgtagtcagatggtaaatttagtctaattatatttagagatgggttaacataatcagaaggtaaggaacccaattatgagataggtgtgataacatagatggcttaataaaatacaaaatagaaagatataaatagaatgcttttatataaattctggaggagtttaaaaatgagtgagtgttcaagataacttagaaggaaagatattaatataaacttgaggtatgttggtcttgaagaaaaatgaaaaagctcattttgtgaaatgagtggaagaataccagctctttttcagattttcaccattttattaatattttttgattatagaattttaattatgtaggaaggaatttattaaaaagtaaacacaaaataaaaccaatcatatagttttggccaaattgttgcttttcttttacttcatttcctaaagggcatttctcagagtcacttgaaagtaaaacttgagagggttttatttttttgatttatttatttattttttttagtggctgtttgttgaaaaaccttgttgtaggctgctaggcattcttttactaagaatttcgaatgcacctcatgtgcaaaagactgcttaagtgtgtcactgcagaaactagcaggatttcaaaatcaaactcatcagttttctgtgataggatgatggtttgggagatactcaagaaaggagtacgtgttagtagctgaagatttttctgtcttcttccttgtgttgtcagatccacacttttattttccttttttttttttttgagacggagtctcactctgtcaccaggctccctgcaatttctacctcctgggttcaagtgagtctcctgcctcagcctcccgagtagctgggattacaggtacgtgccaccatgcccagccaatttttgtgtttttagtagagatggggtttcaccctgatggccaggatggtgttgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaatctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaatcctgggactttcactaaaaaactgtggttcttattttaaaaacaaaacaaaccaaaaaaactgcaaggaagcaaactccacaaaacccatcaaaaccccaaaattttcttaaccttaataacttgttctttttccatgcatatctaattcctccttttaaaaaatacctaaaaaattgaaattggtttaccacatattcctgttggcccacgacacataatgattaatattttttcctttataaaaaattgattgcttttactgtgacaactttgacaaagtctttcaaagagggagagaaatgtgaattcaaaaggataatgtggcttttattttttttactttgatcctgttttgtgaagcattacctaggttagtattgcctcatgttaatcagtgaccataaaggccattaggatgccttgatagatgcccttggtctcccttgactttgattgaagcatcttaaaggcctgtatgcatgtggcacaacatctaacattgtaattgctcactcagtagctctgagcacttactcttcaataaattcttagatgccgtggggatggcgaatgaactttttaattacatgtctgttgttttctatcaccaggaactaaattaatgggaaattagttcacaaggtttattatgcattttccctctttaagaggggactctttctgacagcccttccacttttatccttttaccatttttttttattggcctcagtactgaaattccttctttcttgttccaactacatcagaaacattcaatagacttagcagcctatgaaagtctgacaattacttcctcacggcagccttgtttcaagagtaggtccagaataaataaaagtttttcattttcctggtggcatctgttagttttcaacattgcccagagaaagagttactgtggaatacaaaaaaatgagctatttttttcttccttttggggagaaacagacatatagaaaaccatgagtgcttccttcataaatcatattttatgtgcaaccagtaagagagagagatgatgatggttgtggaaaagtcatagtggataacctcaatttattcagtcttctgagataatgtaagagtaaagcatggaaacaggaatacagagttcatcataattatagatcatccattcaaaacattttgaaaacagtgctatgtaaacttgggatgacaaataatgaagcatagttaacacttctcattggttgtgaattttcaaatacatccaagtatttaatcatggccattcatcattctgtaaatcaaaactaggtctttgaattctctccctttcctattctcagattaaggcatatttggtttcatataaaatcttatgcataattttgaatttcttgggccaatcaaataatggtacataatttaatttaaaaaacttttcagaaggagaaaactcatgtttcacatacttcttattaatcctaaggcctagcaaagggtacatacagctgtagttcacctcaattatacactgtaaatatttagattagagacacgaaataagttttgggagttgcaagaatagaatcagatgtaggaggtattcttgtagaatagagatggagatgggatttaaaattttttatttcactgctagagcaataaaatcagtattaaaaacaaggagaggctgggcacgatggctcatgcctgtaattgtagcactttgggaggctgatgtgggtggatcacgaggtcaggagttcgagaccagcctaaccaacatggtgaaaccccgtctctactaaaaatacaaaaattagccgggcgtggtggcgtgcgcctataatcccagcaacttgtgaggctgaggcaggagaatcgcttgaacctgggaggcggagattgcagtgagctgagatcagaccactgcactccagtctgggtgacacagcgagactccgtctgaaaaacaaaacaaaacaaaacaaaacaaggaggggcatgggcttggattttcataggaagagaggctgagaagaacaagaatgctgacatttgttttgtgaaatgggtctgaatgcctataaaagactagcaggtactcagacatgcctgtcaccacttggcagcaaagcaaggaaataggacagtattacatttgtgaagttgttgatcagaaaactagtgtgcagaggaatttgtgtgttttaaaatattcccaaagtggcagaatattactgacatttgaaacaatagcacagtctacctatgttaaaatggtatttccatttttaaattatattttttcaataaaagtcttgctctcttcttaagttacagatttttactttttcattttgcttgttcctgtgctccttgatccatcaatgaaaatgtgattttctgttggagtcttcgataaatatgtaaggctattttcattgcatcagaaagctgaaagggaccttggctgatcatttgtgtaattgaatcgtgtctgcgtttagggcacaattttcattttatgaaagaaacacaagatttcccatgatgttttgcatgtctacaaattcaggcgaatgagtctttcctcgggctcagtgagatcagtggggtcatgctagtgaattaactggcatgatatttgcttaacaaaagcatgccataaataagagacttaatagtcagttggcaagttgcttcatgctaatgctgtttttaaaatttaaagtaatggatgaaataaagttttatatacatgtctggatttttgaaaaataagaagatttgaggcatagtgtattatagcagaaatgtcttttaatttatttttagttgttttgggtacatggtaggtgtatatagccaaaaaccacaattacttttgcatcaacctaatatttacagggtacatgagatgtgttaatacaggcatgcaatgcattataatcacatcatggagaatgaggtctccatcccttcaaacatttttgctttgtattacaaacaattcaattatacatttttagttttttaaaaatacaattaaattattattgactatagtcacccagttgtgttatcaaatagtaggtcttatttgttctttatagctatttttttgtacccattgatcatccccaccttcccccaccccaaccctcccactatccttcccagcctctggtaactgtccttctatttccatgtcttttaaagtgtctccctcatttctgtgtacatgtgactcactggggaataaacagggaaatcctttgtgatgaatcagatgtcattctgagacacagagcttcttatacttttctttaaaatcatatttgcccttctagatcagtatcaagcaaataacaaccaagaatcaacatgcataaaaatgacaaggttatcccagagttctagttgtcattttcatagttgccagcacccttttccaggaaaacaaagagagtggccatctaagtgatgccgttgaggaagctgcctttcccctaatttctggagagcctagtgtagagggagaactcctgcctctgggaatatagcttttagggcatccctttatccattctccaccattccttcagtgaaggaaattataaaagcaaaactgggacccaaggcatgctttgagtctctttgcctcagcccgggcaactgtattctccgaattgagttcattaatattgtcttcttaggagaaatattatctttctccagactgggcagggagtctggcttgagaggcaacaataaagaaagaatatgtcttcctctataaagaaaggccactttataatgaatttcctttagatcacgaacagcactgtaagacccagactgtcaacttgtgcttttgaggttaggagctgagaaaactcttcttgattaataattgagacctaaacatggcaaaaaacaggtctgcctcagcacggagatcatgcatcgaggtggcgggcgatgccttcagtgggttctcttttcttcctgtctcctctgcgattatgtggcaagtttagagtcaactacaggaggagtttcagacaagaagcacagtttgatagaaactaatttctggattgtgattgtgtgagacctcctgggtgttcctgagactttcggaggatgattcttggccttgctttgtttttgttcttttcttctttaggttttcatctgaaggcaagtaactcatgtccctacaaggaaattcccctgaggaattagagataagcatgcatttctcaataaaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaatattgtgaaacttcagtttccccatttaaaaatatggaggcaataatagcaattacctaactggttattgcaagcattaaaggaggtcatcaatttctgtttgaggttggaaaatccttcaaaagctttctattcatttgagtaacaagcaaaacattctgatttaatatctgtatgtgcttcagtgtctttgattatcacatttagaatattcaatattttacttgtaatagtgaataaaaagtttgctggttgagagagtgaataaatgggtgaatggaagagtaaataatgactcttgtaacactattagttatggagtggatacacactagaccagtggggctgagaaaatttaaaaaatattcaagcagtagaaatttttacttaataaatattgcttgggaggctgaattaatgataaaaataaatgttttgcatttgacattatctacccaataattcacttctctctgcattctctcactctcttaaagaagggtaccacattgatgatgctaaatgattcttgtagaaccagccagaggtggaaaagaaagtagttctgacacttggttaaaaaatatacatatacataaataaagtcaaactccactgccatctctactcaaagtgtgtgcatactttcttaagtacacgctgagatgactcattttacacttctttttttacatatttaccctgttttaatgggttggggaatggcaagagcaaaggaaagaatagctgattaccattcaagacacacatccaaatcacataaagaaatctttagatctgagaataattgtgaaaagaataccaaattccagtgtagctttaaaaagtgcaccgttatctttaattacctgcttgatagaagaatatttattttggaataagaaggaataatttcaaagttgatggccttgttataaatataagcaaattaacttttttagaaagccatttcgaactccgaagacaccagcaacatttttattgattaattctttagtgttataacaagcaagttgtttttatgccgtatttatgagctggtatataatcacacatctcaggggtggagaggaccttaagaatcatccacttcaacagcttatttgaaatgtgtttgtttttatgttctgtatatattctgttcttttggttatctctctctctctgtctctgtgtctctctctccatgtatgtatgtgtgtgtgtgtgtatgaaatagataatatatataaattatcataaaagtatatttacatatatattttaatgcccactctattggacttgtaagaaaatcttacttctataaagtactctagaggcatatacttgtagcttattttgtgacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagacaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttttttatgatatacttgggacattatattgatttttaaattttgtatacagataggttgtattatctataaatttcaaatcatagatgatgtaacttattatgtctatgataatgaaagaggcattaaattatgtacgagtgcaataaggagttgcgtttgatagggccaaaaagccctgaaataaaaaagcagtatactcaggggaatttgctacatcttctagtacaagtagaattatggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgcattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagagaagagggaaaactagattactagaatgtaatctgtttaagtcttgtaagactacaaagtccttactaatttgatgtgcatttctctgatgagcatttctgtagcactggagtccagtgatgcagggatgggttatccacattttctgccactcaagatctttccatccaggtgatccagctagttctcaggcccatcaaactttgatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccctccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatactattccatggtgtatatgtaccacatgttctttatccagtctattattgatgggcatttaggttgattccatatctttgctattgtgaacaatgctgcaatgaacattggcatgtatgtgtcttttccggtgaggttgcagagaaaagagaacccttacacactattggtgggagtgtaaattagttcaaccattgtgggaagcagtatggcgattcctcaaagggctaaaagcagaactaccgtttgacccagcaatcccattactgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggcagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctatatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaatatgagatctcacaattattctcagcatttcctgttcattgttttgctatgggtagcatgtcctgattactcagttatacaaaatatttgaatggcttaaaggagtatttgtgtttgacagcataaataatattgtttttgaaaatgtatgaatacagatagaaatcaatggactggagtatatgcatttgtctatcttggattgatctagtgtattgagtcacaaaatttagttgatagaagggatagagtatgagaaacagagtcccacaactttgcatcaacttagaaaattattcttttatttaacattcattcattcattcatttattcaacatttttaagtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaaaaaaaatactcttttaaaaatattactgctcattgacaatacacctggtcactcaagagctctgatggagatgtacaagaaggtgaacgttgttttcatgcctactaacacaacatccattctgtagctcctggaccaaggagcaatttcaacgtctaagtcttgttattgaagaaacacattttttaaggtgatagctgccatagatagtgattcctctggtgtatgtggacaaagttcattgaaaagcttctggagaggattcatcattgtagatgccgttaagaacactcatgattcaagggaggaggtcaaaatattaacatttacaggagttttgaagaagttgattccggtcctcacagatgactttgaggagttcaagacttcagtggagaaagtatttgcaggtgtgatggaaatagcaagaaaattagaattagatgtgatgcctgtggatgtgactggattgttgcaatctcatgctaaaacttgaatgattgaggaattgtttcttacagatgagcaaaataagttttcttgagatggaatctgctcctgatgaagatcctgtgaacattattgaaatgacaacaaaggatttagaacattacataaactgggtagataaagcagcaacagggtttgaaaggattgcctccaatttctcaagaaattttattgtgggtagcatgctatcaaagagcattatatgccacagagaaatattttataaaaggaagagttaaagcagcaaatttcattgttgtctttaaaaaaacaattagcacagccatctcagacttcagcaaccaccatcctgatcagtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattcaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgctgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaacatcttagcatctttggttggcacttagaatattctcccacaggcatatttcatttgcctgtatgcttgtattcctcattagcttatttcctctggagagtgagactctgtttctgcatgtaacagttgatcagtaaatgttttgattattactatttagatcctgaacatgaacgggctcctattcctttcctattgctgcccccaatgaatttttacattcaaaaagtaatgacgtgttatcttggtttttgtttctgggaaatattaggaatgctttttggcaaatttcaagggaatcctatttggcattagaaattatttattttgaggcctcgtgtaaaataagcttcaggattttgaataactttgggccctggagagagtaatacctaatgaaaactgcaactcaaagaaataatgaaaggcctctttaggaatcaaggtggtagctctagctcttgaagtcttctaatcaaagagtcaacaaccatttttgatctctgatcgccaaagcaggcctcagaggggtcaactggccatgcagcctgatctcagagtaatggctcctcctatttcaagattcaactcaagcatcaattcctgtaagaaaccttgacagaactgccttttctcccacctccaagtcaatgtgaccactccctttttgccttcactttctctcctgacttgcatttgatcagctaaatttatgtaaaaaaatgaagcctacaaccctaagctgatctgaaacacacagcaaatggaggtagccacatatatatttgataatttcccagtttatagcataacagttaaatcattgtaatttcttatggaatgtatggatcaaacattacatttattctgtattgtgtgcatttggagtaatccatttgacatttttttttacattgtgctagaaaagttaatgaggccactgaagagaaccaaaagtaggaattagaactgaagatacagcaagaattgctaaaagaaaggaaatactgtataaaagagaaaaaagacttttatggagtgattttagagtaactatggctttgtaaaaatgcacatcagtttatcagttttataagccaatgcttggtgggtatggagtttttcagtgatccagtttcaagtaaataagcaacgaataagaagaaattgtgtttctttctagaatgtgttgtcaaccactgaatttaatgctaccaatagatgcagactcatgaagtgcagtatgatttcgataaggcctaagcaattatcaaatcagaaatggatctctcatgctataaaattgtacatttaagcaaataattttaagataattggctttcaaactatttttggatgtatcagaagggatggttgtggaaataacagcacagtaaatgaatagttactggaggacaggaaagcagaaaaaaaatctgaagtgtaaggagatacagtcaagctgtttataaaatacatttagatacaaaagaggtcactgtgtggaaaacctttagaatcactgttgaaagaaaaaaaaatgtccacttcccaatttcaagttctattgggattgtttgtattataaagagttgactaataaattcctgccaaggattatttccctatccaaacaaaatgtccacaattctttatgagagaagatgatacccatagcttctgcttcccgcagtggcactctcatcacatatattggtaagtatagaggtgccaaggagaagcaggcaacagttttctccatagcatccatagtcatgctgttcagcagataagcctagtacagttagtatgtcctgattttttgctaaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctggttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatcccttctatttgtcagttttccatgtccagagttaattgaacagttgtgttaacattaatataacattgcttgctggctaccaacaataatagcatggaagaatgttttaaggtatgtcttctggtagaataactatatcctcattattaacagtgtggaaaatgtagaaatgtagaaggaagcaaataatcactcatccagagatgatccatgttaatgttttagtgtatttttttctatatttgtagctttgccaatttcacacagttactttttaatatatacaccggggttaagtctttgtatgattacaaaataaattcttgttcaatttttgagaaaaataaggaaactatgaaaacagtataaagaagagcatgtgtgattcctagaaaacagcaaaaataatttggaactgcttttaatgacaagggtaggcaatcaagtttgctaaaatgaataggataatcagctccagccataaataaattagtatctttttaatgtgtctgttgtgtgtattctgcagctggctcttaagtaatttttaaaggaggcctgatatgtgttcggagggggagcaacatgattagaatatggtagctagcttggaataggcatcatcaatgattcgaatgcatgctctagatcatgcatgctttggaagctacaaagcttctccaaatcttggagaagcaacacagtgagaaacctgtcactaagcttttgaggattcctatctggaagaggactgttaacagtaaactcaggctgcagttgattttctttccatcatcaacatattatctgggtctagtgaattacaaaccctcctcttggcttaacattctctctgatggctttctgcacattggcttcctcttcttgctatcacggtaattactcaggagacataccataggttttcttgggtttagatcagcttaggaaagaaaagaaaacttaatcagtgaacagatttctttggcattttccatgtaatcctgggacccctgcttgttagttttgtcctgtttcctgttacagaaaaggctgaaaatcagcatgcagatgaatgagatagcagatggttttcccgtgatagagaccaacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctctgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtggaccttcaaaatgattcatgtcttagaaaatatgatttaagagaagttaggtctatagggtcattttatctgaggaaagatggctgtaaggatctttaatgataggagtcaaatatatgagagattgttgcaaggagaatgttaaccagctattctacaactcgactggggatagaaatagctttaaattacaatatacagaatttagattagataaaggaagtatgctctgaaagtaagagttgttaaaagttagaatatgttttccaagtaggttacaaaattgttttaataaaattatttgtgtttattcaaaaataatgaaaacatatatattacatatataaatattgatatattacatatcaatatataaacctaggatataaacccaatatgtaattgatatgttacatatcaatatatattatacatgtattgatgtcttacatatcaatattatacatgtgttgatatattacatatcaatatattatacatgtgtttattatatgtgtgtgtgtctatgtacaaaaagatagctttttgacctcaacagcattataacttgataattgtcttattttggaactcacgctgaagtagctttcagatactgttctagaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtgaggtgattggccacaggtttggaaatggctcaggtttgctctttccaaccccttgcatgtcactgcacatttacctccagaagtaaagcaggagaactctgcaaagggaaccaacaatctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaagggaaacagccatgagacaggatttcacaacctctgcactatcaacattttgggcaagatactcttttgttctggagaagtgttctgtacattgcaggatgttaagtagcatgcctggtctctatccaattgatgtcagaagcaagcaacatccatccctggccactgtgaacaaaaatgtctcaatatctagacaaagatattgcagcatactctggaggacaaaaccagcactagctaagaaccattatcctagagaaaatagaaatggtttagagaagagatcttttcaagatatctaccttggtatcctcagacatactgaagaattacagtctctaaaataattttctgatacggaaaatgaagaaatcaaaggacagaaataacccacggaattttaaagtttaattaacaaaattgttgaaaaattcaaggaaaccttccaaaaggaaaagaaagaagaagttataatatgtgaaaaaggggaagagacaaagagaatccgtttaggaagctaagtgtctgtctaataggaattctaaaaccagagggaaaaagcacaataaatgagacaaaataatcatgacatttcctagagttaaagaaaggcacgtcctcagaatgaaaggcccaaataatgttgagaacaatgaattttaaaatacctacatcagacacatgctaatgaaactttagaataccaagacttaagatcctaaagattttgaaaaagaaaaacataaacaaacattctatcataggaatgacaatcacagtcaagttttcaatctgcatcttgaaaatgccagatgataacaggacagtgacctaatgttcggacagaaaacaaacctaataccaaatggaatcaaacaggaaactcagaaatagacacgttaatatgctcaagtgatttttgacagaggtacaaaagtcattcaattgccttttccacaaatggtgctggatgcccaatggcagaaaaaagtaagtcttcacctaagtcttacaccttacacaaaagtcaactgaaaatggatcacagacttaaatataaaatatgtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatgtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactaggaaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaaccataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaatttgtcttatttcttacaactgcctatgaatttacactgatctctaatgaaaagtctcatttaaaaatttgatagtgcttgattttatcagttgatcaagctgctcttagttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatctgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggtttgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaacaaactcctacaaaagtttttggttatggcatccattttggaatttgaaaaatatatataattcatctgaaataaatgtataaaacagctaattttctggtaagatataatatgtgggattatcactactacttttcaaaatgtagtctaaagaatattacttaaatgagctttatgctgagtaaagaatatgggggaaaaaaccctaagagtataaaagcccagaaagagcctcttctacgtatgagagtgtatgtatgatatactatattaatatatgtattgtttaatataacctattttgataaataatagtataatagactatattatatactattatataatatagggaggaaagtaccattaaataaaagatactggagcaactggataactatttgaaaaacaataaacttagaccatttgttgcactatacaccaaaataaatttcatatagattttaaggttaagtgggaacaaaaagatatcacacacaaaaaactgtatctgaaagtaaatatgttctccttatagtagagtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataagagaaaacaagacaaaagccatatatgtagataattcatcaaatggaaaattataaataagcaaattttgaaggaaaataaaataatatgttctatgattaaagtggtcaatgtctttaaaggctaatattaatagctgacttgtggtctgtaaagaatagtttatttaacatgtgacttataaaaatatataacacttttggacagcatttttagagataaatattccacactttttgtagcattgattaactttattcacatcttaaatacttataaaaatctgaatactactttatttcaatgttatttaaattggtgtcaagttctggctaatctacctaccgaatagtaagaatattgttatgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccatgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcagatgatataattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctcccgggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcacccggcccataattactatttctttcattatgttctggacactccaaattttcaactacagggtccagcctttgcaatcaggaaaaaaaaagtgtttaaaaacatctctgaggacttacatataacaccagaaggatttatacatttatttagttaatgtggttaataaaaccaaaatattctttaaaccatgtcttagcttcattcttgtctgcaatactttggcactgcctggatttggcatcatgaactgctgcaactaaaataacagtaaggtgcatttatacaaaggaagaaatgagagattaaggtcccctgttaatactaaggagcctgatagattttgatatgttttgtgcactggtatctgtattttcattttattgatttttttctaaggaccttacagctaaagccaggtccccaaagaagtcaggggtttttgtgttacccacaacttggcagaatgtctgcaattactccttctgcttttaactgactttgaatcctctccttttggcttgagtacctggctttcagccaggagaagggaaaatactctatctgttggttttcaaatgtcatttcccctttggctttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcctgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttttcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaacacattgttaatggtttgatcaaacatctttagtagcaccttttcattcatgttttattatgtatgtgtgctacccactttctgtgcagaaatttcaaggaaaaggaaattaggctttctgtaatactcctaatccctgtccttaataagtccaaactctttaacatgatacataagactttcactatccggggaccccagggtactgcaccattctcatccatgtttctcacctctaagcttgtgatactcctgtcatgcagcattttcctttgttgtccaaacgtgtcctgctttaaatgttaccattctcaattctcatctgcctggtgaccttgtgtttcagtggttgtctggagcgttagtgttcattagaataacctggagggtttgttaagacatagcttcttggacgcccacttccaggtttctgattcagttgatctgggccctgaagttgcctttctaacaagtttccatgtggtcctcttgctgctggtctggcatcacactttaagaagtattattctacttatccttcaagacctcaacctaattgatctacagatccttttccaactataggaatatttaattgcttgttactctatgctttcaagctcttgtttgtgtaacatctcacattttttggtgactatttatgagtgtcttctttgcttaactgtcttccttttacaagggaaaagacttgtttgacttgtgtttagatcctcatgggctaacatgatgggaactcatgaagaatttgtatgaataaataatgaacctggaaacctttgttcatttaaagttgcttgtacaggatgaatgttttgcttcattggtttccattattattgtcttcgttcccattcaaattctgtttctaggcaaactggaagaggaaaactatgtaaactgaaaatacaattctaagcctcccaaccatctgagtggaccccttctctcaaccaagggcattccaaagttaacctgaaaaactagttcaggccatgataggatgggggagtaggacatgcctcaatattccctcctcccttctggaactcaggcacagctgaccagtattaacattaaaatagattttaagactgacaaggcagactgtttatagcaataagataccacattccagcctgaatctagtatagtatcacctgacagatagcagaccctgaaagaaatcaaagtattttatctcaaattatggttttttgccatatcttggaatagtcctgcaaatctgtctctcatgaggaaaatccacattctgaagagaatccctttccttttccaggcctctttcctgatccagaagaaaatcaactctgataagaaacatttacaatctattctctctgaagcctgctacctggaggcttcttctgcataatgggaaccctggtttccacaaccccttatcttgacccagacattcccttctattcattctaggtctttagactataacttgactctttcatccaattagaaaatctttgaagctgtccgggcatagtggctcatgcctgtaatcccagcactttgggaggctgaggcgggcagatcacccgaggtcaggagttcgagacaagcctggccaacatgttgaaaccctatttctactaaaaatacaaaaaaaaaatgagctaggcgtggtggtgggtgcctgtaatctcagctactttgaaggctaaggcagaatcacttgaaccccggagacagaggttgcaatgagccgagatcgcaccattgcactccagcctgggtgacaagagtgaaattctatctcaaaaaaaaaaaaaaaaaagagagagaaggaaagaaaatcttagaagcccctcacaccttgccacttcaaattgtccccccttttcaaatcaaaccaatatacatcttacatatattgattgatgtcttatatctccctaaaatgtgtaaaaccaagttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcagagtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattactagcagtggttcctgctctcttctttcttttttttctttgcatccagattcaattcctaaattactcccagtatgacagtgatttctactgtgtttctccttcactctctgcagatcattgaagaggtagctgcaaatgcctttcacttgcatggcttttccaaaatgtattcagattggctgaatttctgaatcaaatacaatttattttctctcttatcctagcagaagatttaagcaaagagatatgtaaaatatattaaaaaatttttaagtttccttttttttttttgaggcagggtcttgctctgtctcccaggctggactgcagtgatgtgaacatagctcactgcagcctcaacctcctgggctcaagtgatcctcctgccttggcctcccaaagtgctgggactacaggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatccgttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctatacttggctacattctcttgtaaacattttcaagctttttaaaaaaattccaaggttaaatttgagttgtagaaaagaaatatgaataatggccatcataattattccattataaaaacacatacacacactcaataaaatgtgttgttttaaaattattaccctaaggcaagtggtgaatagatccaataaaaataaaagaaatagaatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtaaatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggtagtgataagatactggcgaccacacacaaaaatggaatagatatctgtgtctgtaaaactaaaaactcttcaagggagaaaaagctctagtgaaaaatggaattcaccaggaagtcactcaagagaatgcaagtattaaaagcactttattataagataaggatgtcccattcttaaaataatctcctagggaaggcttcaaggatagcattatactaagtagagaagttgtctgacaaataggtaagtataaaaatcagagaacctacagaaaacaaatcattctttgagttgcatgaactttaggaaagagtctttatcagccatgatcaaataaattggacaggtcatataacaagttagaagttgccaaaatttttttatagaagaaacagatgtcatcttcttttgtaaactacatcctgaacatatcccatcctgactgcttcgtggcgtatataaactcccactccacccccttttccccgtctcaagcaagctgacctaccaagctgtgtatttttaatcactttctatagcaatcaagaatttgccatcagagaaactgcttcactgcgtcttatctttccatgcctgttcttgctaaacagatttaagataagagcaactggcagtaagtgcccttcctgaaaacagaggtcacagatgtttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcatgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattgctgaggaaaactacttcttaagacaattttacgactgcattgtttcaatagtacaccaaactatgttggaaagttatgacctagaatctgaaaaagaaaaaagtgatgaaggaataatgaaaggctgcatgacagaagtatttagtcttcattcctgtgtttgaagcagaaaaaaaggtattgagggctaaccagactctgccttttgctaaattgaagagtatcacatcaaaggccaaagatccattttaacaggtgccttaaaaagttgtactaaatgatctctgtgcccctttggatcatgaattgtctacataactgcacaacgaatgaacgtaagaaaaatgaattggctggtgaagcctgtctggtaaacaatccatgatcctgagggaattgtagttttgcaaaatattcagcaactactttagtttaaatattttatatgactcattgaagctccaggaagatactactttcttctcaatatcagttcctggttattgtcatcattcctttatcagagtttgtttccttgtcaaatgaactcttaatacatgtatctatcactgacaattttgtagaaaggtcattatctgttctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattacaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccaggaatgagaatgaacagatcctgggataagttaataaggttggatttattaatcacctgagattctcttttttgattattgggtcatcttgtacacatcaactctgattacaaagtaattagtaatcaataattatttctgcatgtgccactggataaccattcaatacgtaaaaatatttaggtgaaaactttgcttgccaaagtttcaaaagttaaatacttaccaggctattatcactatagaaaacaaaggatgagacgttactatgaaaaggatgggtacaaaagtcatttgaagaagaaacgtactaataaaaatatatttcttaagtactttagtctgcaagtggcataattatttgtgtgcaatatccagaaatacatgcttcttggtgggttttaacagacatatttttacaattaaaaagtatatgcctaatttatgttgtggcagattacatttttcaaagacagttacactgataaatcccaacccacatggccatgttataggtgatgttgacactcctccattgggaggtatggaccagttttagtgactcactttcgtccaatagaacgtaacaggaataatgctacagtccaggtcataaaagggagtagaacttctaccttgttctccctctcatgatgttagaccttggaacacagccacatattgtgagaaagcccaaactaccccatgtagagaaatcacatggaaaggcccacagagagaggaactggggatccagctgatatttagcatcaattgcaaaatgtgagtgaaggaggcttcagatgattctggcctagagccttcaacttttttttttttttttttgagatggaatctcactctgttgcccaggctgaagtgcagtggcgcaatctcggctcactgcaagctctgcctcccgggttcacgccattctcctgcctcagcctcccgagtagctgggactacaggcgtccactaccatgcctggctattttttttgtatttttagtagagacgggatttcattgtgttagccaggttggtcttgatctcctgacctcgtgatcctcctgcctcggcctcccaaagtgttgggattacagacgtgagccaccgcgcccggccgagccttcaacttgattcttccatgagaggccctaaacatcatggcaaagagtctaaccatctccattgtgctctgtctcagttcctgacccacagaatctactagcatagcacctctaagttattgagtaatttttagatagacaataacaagataatatgtcaatctggttttcatatctaaatttatactggctccagatattcacttaagattttatcttggccaggcatggtggatcacgcgtgtaatcccagcccttcgggaggccgaggtgggcagatcacttgaggtcaggagttcaagaccagcctgaccaacatagggaaaccccgtttctactaaaaatacaaaaattagccaggcgtggtgatgtgcgcctgtaatcccagctacttgggaggctgagggaggaggatcatttgaaccctgcagaggatgtggtgagttgagatcacaccactgcactccagcctgggtgacaagaatgaaactctgtctcaaaacaaaaaaaaatttctctctaatatacaaataatatcactttcaaaaatgtatctgctcttctaaaaactcagtttccaaatagtgggctagtcattttgccaaattttagaaaacagttttaaaaaatcacacgtagctccaaatgtggtgcactttccttggttttgttcagtgctcaatacattgatgttgctaaaggccatatcagtgccctccgaccatggaagtttggccataactagttcaagccctgaagaactgaccctgggagtcaatccatatgctgctttgtcccaccaagaagaatctctcttctaagattttgaactaagagattgagagttagagagtagctatcgctgaagctgtcaagatcatctagacttgtaccatctcatgccagtcagatgactgttattaaaaagtcaaaaaataacagatgctggtgaggctacagataaaagagcatacaaattcactgctgcttggaatgtaaattacctcagctactgtggaaagcagttagtcagtttctcaaagaacatttgacctggcaatcctattattaggtatatacccaaaggagtataaatcattctaccataaagacacacgcatgcatatgttcatcgcagcagtgttcacaatagcaaagacatggaatcaacctaaatgctcaccaacagtagactggataaaggaaatgcggtacatatacatcatcaaatactatgcagtcattaaaaagaacaagatcatgcccagtgcaggaacatgtaaggaactggaggccattattctaagcaaactaacactgaaacagaaaaccaaatgctgaatgttcccacttataagttggaggtaaacactgagtacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttaaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttccagtaagctccttttccacaaacaagcctgtttgactagcttcttaatattaaaaccaaataatttctcaggtggcaataagggggaagtggagtgcattggtcacacaaaagacaacaacatgaaaatcttaattgttttcagtgtcaaacacttgagtttctggagacaaaactccctcttctaagaaaatcaaactattatacatgataattgtcactttgttagttaagacacatttatacaacattttaagatttggagggtagatactttattaataggtggtatggttctgttcttaagttatgtttctgatttttagatagatcattccctgtttctgtttgtgggaaaaatggctgtctcagtaggctgcattataaactcagttggaaaaaactggtttatttgttgaatgagaacttcatttattttgtgtaaatgagcaccactttttattattcacaggttattgacaagcataatattaagttaagatgcttgacattaaaggattaacatgtacaaatttgaaaaacaacagccgcctagtagacactcagaatttctgttcattgatcaactaagcataatatctctgctctttagcaagtggtttaaaaaattgatggttattagtagtataaatcttggaaaatttgcagagaaaatataatttgtctattctaagtatgttaaatggtttaaatgatatgttaaatagtttaaatgatgaatagcgtgaacaatattagctatactgtattagccattagccttgtaacaaattactcccaaacttaccagcttaaaataacaagcatttattaactcagtttctatgggtcaggaatccaacaacagcttcatggaatgaccccaactcaaggtctcccatgtgactgtcatctagctgttggccaaagctgccattttaaagacatgaatgaaacaggattatccacttccaagctcactgtgtggctgttgtcaggaagctttagctccttaccacgtgggattctccatgtggctatttacgacatggcttccctcagagcatgtgacacaaatgatcagagaaagatctaggtgcatggcctcatctcagaaatgaaaatccttcagttttattgtatcaacacaggtacgatgtaggagggacaatacagtgtgtggaagctggagatggagatccttgggagctgagttggaggctgctaccatagctatatctcttgctagagttcccgattttgcagcctgccatcacctcacctaagactgaacagaatcactgcctagatttacaatatcccagtatattctttttcatgtgcactctcactttacatctcaattttcattccgagcagtacttttaagaaagaattatcttcccctttaatgtgaggaaaaactcccctgtgtataaaaacaaaataatcattcaccatctctttctagtgtgtgacatgcagtgagatttaacttcattgctttgttagaatattctgttctctgtggagggccgtgtttttaaaaaatcactcttcagtttctgctgcaaaaataaaataaaattctctgtgaagtttgtcaagtgaaatggacacaaacatggctcaaagtctagaggaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcggtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggttgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaatcctaagcaaagttatgtagttctcgagagttatagaaaaccaggtttgcatcttggctctgatacccctccctgtgatactttagaaggcttacctggcctctaaaaacctccatcttctcatatgtaaaacacaaaaaaccctgacacatagtatgtgctttgtaaactgtagctcttgttaatagtgaataggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcaactatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttccttcttttgtcccacccctacccatttcagccatgcatatgtgtatttggagccctggatcttcaaaaaggcagcaaggagctaattaagccattaatgaattaactttattttttgaagtttataacttatttagacttagtgatctttctttgctcattaacacctctccctgtaggcagagagaaaaaagattaaaatgtgactctgtgaattcttaggcccatataaattcctaagtacaggggaaaagcatcgatttgtaagtcaacatgacattagtcagaagtgttggtttttctttatctgcaggatctgtttccaaacatatttgatacccaggacttgaaactacatcaattatttgaggaatcttgttagggctccatttgtatggagaggtaacactcactggtggcagtggtttgtgggtagaaggggccttcgggtatgtgcggcaaccttgtcaccagaagctgacaccaacaatacacactcacatttaaaaaatgccaaaattgtatccatcacctccaaaattttccttatgtgaaaggttttggcaaatccttgccagattttaaatgattcattctacatttgtatttcacagttataaagcagaactttgcacaacaagttaacttgccaaaatattatgtaaatattgccaaaatattatatcatcaaaatattgtataatatctgtgtattactttttgtattatatatttgtattacataatttgtgtatttatttgctgcttatttaatttataaacataacagaaatataagggaaaaaaagccagataaattttccagaatagatgagaaatggagaaatctgagtccttccttcaagttcattgattatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagctacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaactttataacatccctttacagagaagacattttacagaggaagacactgagcatcagggacattcagtgactgctggctggtaggcagcagaggtcttgaccagacccctggcttaatcttcagagttcttccatgctgatgcatggaagacttgcccaaggaagttgtctccatatgaaacagccttgaaaataagatgactttcagtctagtttgatcaacatttatgtaaacatgtaattaaaaattgtttgcttcaactcaacagtatgtctctgaatgggaactggttctttctcaggaatattcttggctgaatgtgtctgtgctgtgtcatatgcctcctctttacatatgactgtgggagggtgtggctgtttctataaacactgaaaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaacgaacctaatccactctagccactcttcgtgatgtgaggtcaagagggtgaacatggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaaacaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcgggatctagaatatgctatatcttgagtcttctaaaatgtgtccagcgtctgttctcagtgcaacaataaactatcaaagagttttaagcagggctatgagtttatctgacatctgttttaagaggtcattctattttatatgagtggaagagacatgaaaaagaccagttagaaggctaccagaacagtccagcagagagatgatgttgggagcaaataaagaattccactgtggaaatgtcacatttgagatgcccaagagacatctcagtagaagatttcaagcatccattgtatataaaaggctagagctcaaaggagaagtctgggtcagagatagatatttcagagttttgaacatatatgtgatacgtaaacaggaatacagattaagaataggggataggatcaaaccttgagaaattcgaatttttaagataagatatggaataaaaagataaaactgtgaaggaaagtcagcaatgtgaagggaagagcaagagtgtggagttgtcaaagagaagaggatctcttgagaagaaaggagtgtttgatttgaatgctgctgagaagtcaatacaaagaaggcaggttttacaacaggaccagcctcataattagtgcatctttcaaggagtgtgaagtactttcttcactgatttctgacattccgatttgtcttactttacttcattgcaccaggaggaatttgaagatccatccaagttgtcagccatgaaaacaaaagtgcagcacgtgagccccagctgtgctcctacctccttggtttggtttccatgagtagttaagcttagaaaaattgtgaagaaacttgttgtgtgggagcgatttttcaaagacctacaaacagaagtaccacttgacccagcaatcctaaacttgtatatatacccaaaagaatatgaatcattctatcataaagacaaatgcatgtgtatgtttattgcagcactattcagaacagcaaagatgtggaatcaatctaaatgctcaccaaccgtagactggataaagaaaatgtggtacatatacactactgaatactgtgcagctgtaaaaaagaacaggatcatctccttggcaggaacatggatggagctggaggccattgaccttaccaaactattgcaggaacagaaaactaaatacctcatgttctcacttataagtgggagcgaaatgatgagaccacatgggcacatagaggggagcaacagactctgggtcttaccagatggaggagggagagaatcaagcaaaataactaatgggtactaggcttaatacattgggtgacaaaataatctgtacaatgaaaccccatgacatgagtttacctaaacaacaaacctgcacatgtacctctgaacttaaaaaagaaactttttctgtatcttaggatcatgagaaagaatcacgttcaaagagtaacaaaattgatattatatttagacagggaatgggattgcaagtgaagaatctgtggaatctcttgatttgtgaagatttcttttagagttcagtaatggatctgtgacatccaatttttctagttaaagagaaagagcattgaactaagaatcagagacttggtttgcagtcccggattcattggttattggttgcttaaacttgggcatgtcacttaaccattctgacccctaatttccttatctgaaaatggtaaaaatcatacctacctgatagacttgttgtgagtgttaaaatgatgtggcttaaaacctagaggaggcattcaattaatgataccttatttttattaatattagcatattgggagtaagcacagggccaaatgcaatcatgtatagaaaagcattccgctaactataaaacattgaataaaatgcgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggaagcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaatgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaatatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattgggcactgaggtttaaagaggttaagttaatttctcagtttgctatagctagaatggaataggtccattatttcaatataggtttgccagactccaaagcatgtactggaactactgtggtataaaacaatatccactccttagaaagatcagcatattcatcttctatgtcctatttataagtgaaccggtgtgctcttccctctttattgagatttttttcaaagtaggaaaaagggaaggaaaaagcatttattgaccacatgccatatgccatatttctttacaaatattttcccatcattcttagaaataaaccccaaatgaatatttttgtccatgtctttcaaatgaggagattgcttagagaagttgaggagttcgtcaaaatccaccatgcttatttattttcttttcatcttacatttttacatatctagtgattgtcagatactgagttatccagggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagtttgcatactgaaggaaactgaggggtggtcagaaacccagtttgtgcaggaaaaaaaattgtggagatcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctgggtaaaacatctctcatcccatttctaagaacttagctatttatccaaagcaagacctcttgccccctggagctctattccccaaagagaagacttctttaaagagatcgtccttcttagaaaaggagatttttctttcccattcagatatttctagattggttcacgtggatagagaattctatgccttttttagccactgtgactcagatataattcattttgccttaaaacgcaaagcatcagtaaacattgttagcattgttatgtcacccttttttttttttggttgttcacaaattttctttgttaaaatcctgtgcagctttttgaattcacactaaagaactttaaatttccaaatgaagaaatttcctggccagtttttggttttttttttttgaagatgactgctgcctgagtgtcaacatttgagaaaatatagaatttaatttttggaagtcactagatatagcaacctgcctggtgccagagaagagctgtctatgctgtactgcaatttgacttttaatccatcgtagatctgctaatggtatggcacatgtgaagtggtaaattcttgagtgtttgagacaaacattttaaggtacccatacataatgttaagttcacgtttaggaaagtagtaccagttaataagattacttatttgaaaataagaccagtttatttcaatctggatattcgaattatcaaataatctttttttttcaggattttcttggtgtatgttacctttttagtgaaggaccagtgtctcagagctttattttttatggtagtttaattatttaactgaaacctggaagaattaatagggtcagaattttagatcatgaaacatattttattgctcagtggatgatattcttcttggtattatttgctcttccccagagtcaccatatggtataaattattttaaattcccacaattatcagttatgtatatactaataatatcaaaatcatttgtttgggacattttttgtaatttattgaattttcaaagtcaattttgttcagaccattttttttttacaaagtagcttaaaggcacttagaaactgacagtattggatatttcatacgattttttagaattgcagtatctgccatttatctgaggactggtgattcaaaaactctgtttttggttaattttaattaaaaacatgtccactcaaaatactgctcaatacccaaatcattgcctaccttgtatatagttatttttcctaagggcaaaatagctaagaccataaattacgatggcaggcacatggtttgctgacagaactatataaaatactgttttcatcctcatgtcagctctggtacatgcctctttactttaattccttggggaatctgttgtaagttatagttttaaaaaacatccctaccccactagctctgtcagcttacctttttctgactgaccattttatttctctgaaagaacagatagaaactgagttatgtcttagctgaacttgtagtgccctaaatattaatagctgtgaaccagtttagtttaatttggatatttcccaatcttacacctgcgatattgcaaggtagttataaaaagtacacagaattcatctctataaatatatgctcattttatatcctttacaatctgtttcctagattcctaatccaaagaggccattagtaccaatgacatgatggatagagtaggttataatgtttagcagctcattggagatgacatagtttgccaagttaatttacacattttcatactacatatattatgtacaatattttttgtatggtgggttttcatcgagtacccttctctcttgtaagaaattattttttaagaaacatgttaaagagtaaagatgttttaaataagcatttctcaaatggttggtccttactaccaagcatattctggaactgacactttagttttacttacttccagcacatttcatgggaaatggagatgtccaaggaaacaggaagacgttaattgatgatacattttcttctaatattttgatatcccccaaagaaaaaaatagtccaggagatagattatactagaacagtttggctacattatctaaaagtatgttcccatggaaaattatataataggcttagtacattttagaccatttttttcattttctttttttttattattatactttaagttttagggtatatgtgcacaatgtgcaggttagttacgtatgtatacatgtgacatgctggtgcgctgcacccactaactcgtcatctagcattaggtatatctcccaatgctatccctccccctaccccacaacagtccccagagtgtgatgttccccttcctgtgtccctgtgttctcattgttcaattcccacctatgagtgagaatatgcggtgtttggttttttgttcttgcaatagtttactgagaatgatgatttccaatttcatccacgtccctataaaggacatgaactcatccttttttatggctgcatagtaatccatggtgtataggtgccacattttcttaatccagtctatcattgttggacatttgggttggttccaagtctttgctattgtgaatagtgctgcaataaacacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacaatgtaaaagtgttcctatttcttcacatcctctccagcacctgttctttcctgactttttaatgattgccattgtaactggtgtgagatggtatctcattgtggttttgatttgcatttctctgatggccagtgatggcaagcattttttcatgtgttttttggctgcataaatgtcttcttttgagaagtgtctgttcatgtccttcgcccactttttgatgtggttgtttgtttttttcttgtaaatttatttgagttcattgtagattctggatattagccctttgtcagatgaataggttgcgaaaattttctcccattttgtaggttgcctgttcactctgacggtagtttcttttgctgtgcagaagctctttagtttaattagatcccatttgtcaattttggcttttgttgacattgcttttggtgttttagacatgaagttcttgcccatgcctatgtcctgaatggtaatgcctaggttttcttctacggtttttatggctttaggtctaacgtttaggtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagttggaagtcaggtaacgtgatgcctccagctttgttcttttggcttaggatggacttggcgatgcagactcttttttggttccatatgaactttaaagtagttttttccaattctgtgaagaaagtcattggtatcttgatggggatggcattgaatctataaattaccttgggcagtatggccattttcatgatattgactcttcctacccatgagcatggaatgttcttccatttgtttgtaacctctttaatttcattgagcagtggtttgtagttctccttgaagaggtccttcacatcccttgtaagttggattcctaggtattttattttctctgaagcagttgtgaatgggagttcactcatgatttggctctctgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttcctctcctgcctaattgccctagccagaacttccaacagtatgttgaatagtagtggtgagagagggcatccctgtcttgtgcaagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttatatgctggattacatttattgatttgcgtgtattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgtccggctttggtatcaggatgatgttggcctcataaaatgagttagggaggattccctctttttctattaattggaatagtttcagaaggaatggtaccagttcctccttgtacctctggtagaattcggctgtgaatccatctggtcctggactctttttggttggtaagctattgattattgccacaatttcagcttctgttattggtgtattcagagattcaacttcctcctggtttagtcttgggagagtgtatgtgtcgaggaatttatccatttcttctagattttctagtttatttgcatagaggtgtttgtagtattatctgatggtagtttgtatttctgtgggatcagtggtgatatcccctttatcattttttattgcgtctatttgattcttctctctttttttctttattagtcttgctagcagtctatcaattttgttgatcctttcaaaaaaccaggtcctggattcattgatttttttgaagggttttttgtgtctctatttccttccgttctgctctgatcttagttatttcttgccttctgctagcttttgaatgtgttttcatctaaatatttgttatattttttgatgaagggcaaaacattttggttacagtttctttgaatatttcattccacttacgcttttcaaccaaatacaataaaaaaagcaagaaggggttgtcattcttttttttttttcatttgttcttcaatttagcattgaaatattaaatccaaaagacaactacctttagtatgagattgtatattttgaaaatgtgcagaggtttaggtattttataatagtgacaatttacatatttataggaaatatagtttcaaatagattttaaggaggcagctgttaaaatttgacatattactgaaacttaattagtaatatcgaaatatttcagataacacagggatgactgagctaacctgattcaacacatcagttcacaatgttgtgaagaacacattgaacattttcatggaacaatgcattctgctgcttacttcaagaattaggaaggtgaataagatgattcttactctcaaagagcttataatttagtagaagaaagacaataagtctgtgtgcccatacatttattaatacaaggtgggtccgggtcatatcttataatttgtactaagtgtcatggggtagaagagaaaaaaacatttaatgtgatttgaaattgagaatgtttgtgtggatatgtattttatataagatacttataaaaaactaaatgcatcaacccacagattttttgtcttatggcctctgttagaatggtagaatgggaagaactatttgggttgttatatacacaggcctagttattattcccttgagtaaaatagggctttgttacagctaacctaataagaatatttcagtaatcaaatatttaaggaacattgttgaggtggcatggaaagtcaacacaaaaaaggaattccacttgagctgtaattttgttttatttgcttagcgtagattagaattgtgatacttgtactgttagttgcactgtacataaatattttgaattactgtcgctgattggaactaccttcgtgctttaaattaaaaaaaaaagatgtatctgtacattctaaatagtaaaaactctttttggctcaaatcttttaattctgaaggaatatactggcagatacttagtagacataaataatcattaatgcatgtatggtgtatttcattcagtagtaccaaaatctaaaacacattgagttgtctggcatggtttcattgccaaaagttgtgatgtgactctgatgtaacctggtttgttctgaacaactccaaatggttcttcagacttgcccaggatccatctggctcctgggaagccttatgttatcatggctataatcccagactctggtgacagtctgcctgggttcaaatccaggctctggtactcactatctgtatgaccttgaggatgttggtttgtctgtttcccttgcaaaataatgaacattatattccctatctcaaagggttgttgtgaggatactctaagataatgcaggtaaaagtgggatgttaacagcatttggtaagttgtaaggactcaggtgctggctatgtaaaaataaacttttttaagatggatagatacatagatagatagatagataggtagatagatagatagatagatagatagatagatagatagatataaaaacctatacctgaaaacattattttcataatatttcaaaagcttctattgtactatctatgcttttatacatagtaaaagcagatgacatgctggtcctactaaatttacaggttaatttttagatagttactaagaaatcaaactgtgtggaattttctggtacaaaattacaatatgcaataccttcctactgaggtacccattactgaatatttcttttctatcatatgtgaaatgcatcaattttaaatatttggagacatacctaatttaagtgaaaatctcggtatttcctgaaagtcgccacactataacagataaccaatcaaatttgtctagcttataatgtctgtcagcctgggtgatgtggatgggccactgtgttctcaactgcactgtctcagtgattggagccagttcatgaagcgctacagcctgtaggatgccaaggaggttctttttcgtaatcacacacaagcaatgtggtaaaaccctcaagggatagcagttgctttcacaatctatttacacacatacacacacatacacacacacacacacacacacagagttctttgttattttacatctggcaacaggaagagcatgctggacagacctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgagcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaagaaatttctctttcagctgatgtttccctgaacacacattgtgatcatttactatttcctaagtgattcaagcagcaatcttgttttagaatatttcaactgaaatgccagccctggaatttcagtgctgattttaggaattattctaatgacttcttgacaagctttacctacatcaggagcaagtgaacttggcagagttgggataggagacttgcctccaaaatgttaacttatatataaccaccttgttatcgcattagttgttttcatggtggctgtggtggtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaaaatataatgccataaagtcacctctatgtcattgtccttgttagaataaaaattaagacctctaggtttacttttatgggttgagcctttgacctatctgtggaagtggtaagctggaacaacaaagaggaaaatgagagtctgtgcttttaggcaggtagttaatgaaggaccaggtaggaatgaagaagccaagttctagtccaaattgccattgattatctagaagattttggacaattcacttcatgcagtagctcaacatccatcaaagagtttttgaaagtctattatgtgccaggtgttggaagatgtgaaggtgaacaagcagatgatttcaccttaaaagagcttgtagcttagtgggaaggaggaaaaaaaaggaagtaataataacaaagtaagaaaagagctagcatagagctggggaagcaaaacacacagaatgaaagtggaacctgatcttgcagagtcctggaagggttctgggaagagatgactgtgtgctgagcaaggaagaatgaatagaaagtaggcaagaaggaagggtgagatgagaggcttcttgatttgattccagatctcaggttttatttcaccgttaagtatgatgttttagtctctcttttcttttttagaaaccttcactatgttaaaaaacagtttttttctattttttaattggcaaatagttttttttaaatcacaagtaagtattgtgtaattgtgtcagatttttttctgcacctattaaaataattgtataggttttcctttattctttaatgaggtgatatcatatcaaatattagaccaatattatgtatctgaaaaaatatgcacacacacatataaatgagtgtatttgtgtgtatatgacttttgagaatacattaatgagagagattgtactgtaagttttttctaataatacccttgtgatagcaaggttataatggccacataaaatgcattactaattgctttttatttctctttcttggaagagattgtgtatgattgctgtaatttcttccttacgtatttgggagaattcaccagtgaggccatcttggcctgaatttctattctggaaacgtttaaaattactggttttatttatttaaaagatttagggttcttcagattttacattcttctcatgttaactgtaagttacagtttttctttttttttaatgtgttgttattattttttgtatatgtccatagggtacaagtgcagttttgctacactgatgtattttgcattatggtgaaggcagggccttcagtgcctccatcactggaggaaggcacattgtacccaccaagcaaccttccatcatccactatctcccacccctcacccctctaagtctccattgtccacacattcatgatggacagtgtgcactctgcttccatgtgcacacattatttagctcccatttataagtgagaacatgcagtatgtgtctttccatgtctgaattattacacttaagataatggcctccagctccatctttgttgcaagttggtgtttttcaaaaaatttccttatttgggttgggcacagtggctcacgcctgtagtcccaacactttggtaggccaaggtgggcagatcacaagatcaggagttcgagaccagcctgaccaatatggtgaaaccctgtctctactgaaaaaaaaaaaaatctaaccgggcgtagtggtgcacgcctgtagtcccagttactcaggaggctgaggcaggtcgcttgaacccaggaggcagaggttgcagtgagctgagattgctccactgaactccagcctgggcaatacagggagactccatctcaaaaaaaaaaaaaattgcttatccattttattcaaattgtcaacttcattgacataaagttactgttcttatctttttgacatctgtaggatctctatcaatatcccttttgtttttatacctgatattggtcattcgtgctgtagtttttttcctcaataaggcttgttaagagagttttaattgtattagattttcccaagggcaaattgctggccttgttgatgttctctattgtacacttttttctgttttataaatttgtgccttttttttttcactttttctcatttctatttcctttgggtttgatttttcttttttgactttttgaattagagtatagattattgatattcaactttcttcctttctaatatatgcatgttaggccgtaagtttctctttaatgagtttcagctactttccctaggttttgacatggtattttctatattatttaattcaaaatatattctagcattcattgtaatttttctttaatccaggggttatttaaaaaatatgttgcttaaatttaaatgatttgaagattatgtagttatttttctgtatttgagttctagcttaattctaccgtggtcagagcatatggattgtatgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcctcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatcaataattgtatttcaaactagattattcaattcatgtaaacccgatgtagttaatactttatgacaaatttatcgtgcttgagtttggtcaggattctcaattctatatttgatgtcttttatcaagttttgtaaatacttggcctggatatactcaaatatttcttttatctcaatctttatctctccatagcttttgggattctaattacttgtgtcttattcctttatgtcatgtctttatgttcttttctaccatttttatttttttctcaatgttttcatccagaaatttttctgacctattttcttattaattaatcttcttcttctgtgtcaattctgctatgaagcccgtccactaggttttaaattcaattatagaactttctgttcaaaaatttccactttattctttatcattgattttatttcactggtaaaattatctgtctggtcatctttttaaaaagtaatatgaataacagttatttattctaaaatccttatgtaactgtaatatttaaaccatccaccaggtccatttgtgctgagttttctcctggttttcagtcatttgattttgtatgtatgtatgcttggtaattttggattgggtgtcagaaattgtgtatgaataaaatgtaaaggttctggatgatgatctgttatctcagagaggaatgtattttcttcaggaaggaatttaagtacagatagaccagcttgatgcagttagaaagtgagacgattcaaggttttattcctgtcattctgacagcttgttattttcagtttctcctttgtcctaggatacagcccttcagaggtctcaaatgaaagacggggccttttttctttataggtcccaaactccagtttttgtctttcagttccattaaactatggaaagctctgagctactgttttctgttcagcctgtctgccccatcctgcttgtgaataagcagttgcctcaagtgaaataattttcctgctttctggatcttggtctgtcaagttctaactgtcttaatcattcctcagtatcttcaaacatttcccctgcatttatagttgttataagtactagtatgatctaagctattctgttatagctggaagcagaaatgctgccatcgaaagagattaggcattggaataatgtgatctgatttgcattttaaaaagatttttctgaacaacaatatcctcatatgtgcaatgaaacattttgataaaaattgttctctcaggcccttttcagctccaatattctgcaagtcttgagagtactaatagtgtgtcataccatgatttcaagctgtcaaaaccccagggcttttagttttagtaggctaaagttagaaaagcttagactctggggaaaatggccaagaagaagactctcatctttggtgtctttctatgtggcttcatcactgtacttcttgttagctttcagcaacatcctctcttttctgggtcttggtatctgggcacctagactatttttccagtaacctgaccactctctcctcatgtggtggtgccccattccacactctcttctaaaatgtttcatacttgagatttaaaattcactgtccatcctgcatttttctgattttttttagtaataaattaacatttattgggtagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactactttttttttttttttttttttttttttgagacggagtctcgctctgtcgcccaggctggagtgcagtggcgggatctcggctcactgcaagctccgcctccggggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatatttaaaaaaaaaaaaaaaaccttgttatctcagtatgtttttattatgcaaatttcctctaaataatgaaagctcctttttaatgttatattatgatagcaaaaggtgtgctctttgtagagttagcaggatatggttgtgtgacaaaaagccaaatagtattttaggctccaatgaagaggaatatctgtgaagggggtctttcttggtatttttgaagttccacttgaaagtgctgttggccatcactaatcatgagggaaatgcaaattaaaatcacaatgacataccaccttaccccccagccagaatggcgattagtgaaaagtcaaaaaacatagattttggcatggatgtggtaaaaaaaaaaaaaaaaaaaaaaaaagatgtttatacactgctggtgggaatgtaaattagtacaatctctatggaaaacaatatggggatttctcaaagaactaaagacagatcaaccattctatccgacaatcccactacttggtatctacccaaagggaaggaagttgctttatcaaaaagacacctgaatgtgtatagaatcatcctaagtgcccatctactgatgagtggataaagaaaatgtggtgcgtgcatgtgtgtgtgtgtataccatgaaatactatatatatatatacacacacacacacacacacaccatgaaatactattcagccatttaaaaagaatgaaataatatcttttgcagcaatttggatagaactagaggccattattctaaataaagtatttcaggaatcaaaaatcagataacacatgttcttacttatgaatgagagctataggtatttaaaggcatccagggtggtataacggacattggagactaagaagcggggaggctgggagtgagggtgagagagaaataactatgcattgggtacaatgtacactacttgggtaataggtacactaaaatcctaagcttcaccaccatacaattcatctctgtaaccagaagccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgacttttcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttggatttttgaatagtgctttaacattttttacttaaattgtatacattttatagattatctcttgataagcattattttaatgatatatatgtataaataatatatattcttacataatacacacacatgtctatgtaatgacatatatataatattttgcaatggtgcatatgtgcttgttcccttaagatggatatttatttgactgttttcttattgttggattattttgtttcataaataacattctatgctgaaaatatttttaattgctataaattgcccaactaagacatataacttcctgttatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctgtcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcctgttggtgcctgtgaacaggattcttttgagtatgattagtgacatgaaggtcctgaataatatcgtaggcagaagaagtgccattactactcacagtgtaagaagtagcttgagttaactggtgaaagagctaaaagtcaatgaaaagtattgaacttttaaaatgtattatctattgaaaagtttaaaagatcatttattgattaaggaaattcctttgactttaatagctgtgagctctaatgggggctagaaactccagcaagtggtacagtttctagaacctagcagataatttttcattgactagaattccatgtgtgatacaatgatttggcaaagtaaatcacaataattattatgttcattgttttctcctttgtttaccttgattaaccatctttggtgattgtttcataattgttgctttctaaacaactttattgaagagctacaaatggctagctcttctcaaccctttaattagtgtctgggatcggtggatgttagttgaggggaaaaggttattttaataatttaagacaaaacaatttagaaattgtatttttttgaagacaacttgctatgtaaccttttataattccctgaatttttctgaaattgatgttttctttagtgtatagcagtgatagcatgaaaccaccactgacttttttagggcaacttgctggctaattttataaaatttgaactgcactatatgaatgaagaatcatctgtagcaattgctcttttccaaatgttcttttgcttcaaatgccgtatctgaatattagattgtttctccagatgttacaggctcatgtttccttctgctgaattcaattgttggttcctgcttatgtttctcaggatttgtatcatttctctgtcttaagtaaggtttttataaatgctcatcaatgttgtagagtttggattcaattcagatagaggctatttccaccggacttttgctcatctacttcctccctggagaatggtgaaaaacagtcctcttttccctcctctgatagggtgatgggctactattgctttctctctcctaatatattgagtacaccgacctctcaccgaaaccttaggtcaaagtgagaagaggtgattgtttttaattggatgattgctaccatatacttctcttttggtgggatcccaaaataaataaataaataaatgacactccccccaaaaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaccttatcgttttgctgcaatacacgcgtgataattgtcctaaagtgcttagcatggtgtctagaacgtattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcgggctgttctgatggtggggtccaagggcagccttgcttctgccatttgctcagttgatcttgtgaacagctgcggttcttgctgtaactacttgctcgctctcagtgactctgtactgtaaatgtttcatgtgaaggagcactgctctaaaacaaagctggaagacagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattagagcttaccaattacagcatgtgttacaaattataggttccaggactttgggtgaaatatgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatagaatcaagcaaggagttggttgaatccttcttgtgcttttcctttgagatcaccttatttcagaatcctaggaggattgaaacattcctactttgatattttcctctggagatcacttgttaaaagtcgtcaggagtgacatttactagtcttgtattttctctggtcttaacttgaaaagttctgctcatcaaaaatgagtatgttgagatgatattttctatagaaattttgtattttacccccttaaaatcctcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatcacttgtttatgtgtagtatatgattctatgacaaagagctccctttaatgcaaatgtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccattcaatagtctagcttctgctttatgacaatctactcgtgttttttaaaggataataatattaaaacatttttataaatctcacaataatgctttatgtatattaactcatttggtccccacaataaccctgatggatgtcattattattatcctcgttttttttttttgagacagagtttcactcttcttgcctaagttggagtgcagtggcaccatctcggctcactgcaatctctgcctcctgggttcaagtgactctcctgcctcagcctcccgagtagctgggattacaggcgtgtgccaccacacctgtctaattttttgtatgtttagtagaaatggggtttcatcatgttatccaggctggtctcgaacccctgacctcaggtgatccactcgcctcagccttccaaagtgctgggattacaggcgtgagccactgcacccagcctattatcttcattttaaatatgaggaaactgagacacagagagagaatatacattaagatcagaaagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgtagtcaatagtaacattgaatattcctagattttattttataataccaaccagaataggaggcctcaaaacacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtaccttcatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtgtacatgtgtgtatatatatgtgtgtgtatatatacatatatatgtgtgtgtatatatacatatatatatctttctccccctacacacacatacacacacccctttattcgctctctttttttttttttttttttttttagttggagtctcactcttgttacccaggctagagtgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacacatatattgactgatagctactatttaatgaaactttttttgtgtttcagggtctcaactctatctttctatctatctacttatctacctacctatctatttttttctcaattaattccagaatgttaaatttcatgatggcaaaagtcattattaattttgttcactgacatactaagcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcaatcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggaccacagacacacaccaccacacccagctaatttttaaaaaattatttttagtagaaatgaggtctcactattttgcccaggctggtctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgtgacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttaggaggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatgctaaaatatcttcctctatagggaaaagacaatggcaaagaacttttaaaatttttatttggctacttctatttaagtattaagtatatcgcggtgtacaataaatgtttacttaacaaaatacataaaactctttcctgggctaaaccttgaaagacagtcatacatatttcataagttttttgttgtaaaatatttgatgatttcgcagttagggggtttcttagaaagtgctatacataatcagatataacctttccattttatatttccttgtgtaagcaccatgacttctagtaatcttgagtgtctccccttttcaattcacttaggaattttgcatttaaactattgcccttgtttagggagaacaaaacaacacatccaaaaaaatgaccaaatgtgtacaacctggtattacatttctgatttacataatttccacctcagaaaagttttcttaaatacaaaactcactcactttattttaatgcccgaaagaatagcccagataaatggactccaaatttgaggcctgagtaataatgcattttaggattagactagtcatccttgctattttcgtggtgttcatcacgtacagagtacaacaagatactctattatcccttcaggctgttggataaatacaaataagcacatacaaccaaaacaaatcattgtatctgtgaattgaaatgcatgtcataagaactttaatctggtgcaattgctcttatagccaagtaaatatagtcagcaaagcttaccttttatgttaagcattttacagattacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctgtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagatattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaaaaactgtgagtctgcttgctttctcaatggggatgctcatggtatggggcaatttctcagccctgatcatctgctgcctggaaatagactcagtgctgttggtaggggatggtgggagtgagaccggcctttaggactgcaggctgcatgggagtggggtgaggcctgtgattgctggctttcccccacttctctggtatcctgtatgactcaacagtggcagccataatccccctgggaatacaacttcattagactgggaaccacatccccatcccccacagcagccacagcaagccctgccaaaagagaggctgaactcagacacacctatccctgcctccacctggtggtctttctctatcagccctggtagctgaagacaaagttcataatctcttgggaggtctatggccctgtccactgcctaagaaaccttaatactcaaccagatgtccctagggcaagtttgcaacctgtctataggaccacagctgatgcactcttgaaaatgacacctcctggctggaggctaaaccaaaaccagtgcattaaacaaaaacacaaccaaggacctcacagagtccacttcactcccctgctacctccaccagagtaggtactagtatgcacagctgcaagacctgaagagggatcgcatcataggactctgcagatattccccagtacaagcccagagcccagtagctccactgggtggctagacccagaagagcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttatttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaagagcataaataaaaaacaattgcaacttctggaaatcaaggacacacttagagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttcccgaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatgaagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaagccagcactacaagaactgctgaaaggagctctaaatcctgaaaccaatactcaaaatacaccaaaatagaacctccttaaagcataaatctcacagtacctatataataataacacaatgaaaaaaaaaaacccaacttattcaggcaacaaatagcatgatgaatagagtagtatctcacatctcaatactaacattgaatgtaaatagcctaaatgcacctcttaaaagatacagaatggcagaatgaataagcattcaccaaccaagttttcttctgtttttcaggagactcatctaacacataaggactcacatcaacttaagataaaggggtaaaaaagatattttatgcaaatgggcatcaaaagcaggaatagctattcttatatcagaataaacaaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaacagatatttatagaacattctacccaacaactgcagagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgcttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagatactacagccaataccataaaaatacaaaagattattcaaggctactatgaacacctttacacacataaactagaaaacctaggggagatggataaattcctggaaatatacaaccctcctaggttaaaccaggaagatatagaacctctcaacagaccaataacaacctgcaagattgaaatggtaataaaaaaattgccaacaacaaaaaaagtccaggaccagatggattcacagctgaattctatcagacattcaaagaagaattggtaccaatcctactgaaaatcttccaaatgatagagaaagaaggaatactctctaaatcaatctacaaagccagtatcaccctaatgccaaagccagaggacataacaaaaaacgaaaactacagtcagtatccctgatgaacatagatgcaaaaatcctcaataaaatcctagtgaattgaatccaacagtatatcaaaaagataatccaccatgatcaagtaggtttcacactagggatgcagggatggtttaacataggcaagtcaataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagagggaaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacataggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatgaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagccacatgtagaggaatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaactaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaattctcaaaagaagacatacaaatggccaacaagcatatggaaaaatgctcaacatcactaattatcagggaaatacaaatcaaaaccactatgtgataccaccttacttcctcaagaatgaccataataaaaagaaaaaaaaaaaccaacaaaaaatagttgttggcgtggatgcaatgaaaagggaacacttttacactgttggtgggaatggactagtacaaccattatggaaactaaaagtagatctaccatttgatccagcaatcccactactaggtatctacccagaggaagtcattatacaaaaaagatacttgcacatatacctgtatagcagcacaattcactgttgcaaaaatatggaaccagcccaaatgcccatcaatcaaccagtggataaagaagatatgacaaaaatatttatatgtacacacacgccatggaatactacttagccataaaagcaacaaaataatgacatttgtagcaacctggatggaattggagattattattctaattgaagtaactcaggaatggaaaaccaaacgttgtatgttctcactcatatgtgggagctaagctatgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccatgaaaatatgtagccatttttctggctaaatgtaagaagagggaatgaacaattgggttagaaccttcataaaaagacatccacagggaagctacaaagatttcttatggtccccaacaacaagttcgcatactgtgcctaccttgtttttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattagcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtatactatgtgtcagacagctttaacatttttgtatgaatcactcgtgttgtcatctcaaaggtcatatggaatacatactattattgtcatcattttacaaatgaaaagaacgatatgcagagaagtggcttgctgagggcacacagctagtaagagacagtgctgggattcaactctagaccttctggctctagctcttaactttccaagttagtgctgcaggtagaacaaaaactctgtctcataacttctttctccatttcagggctcttgcttgttctaactaatttgtaccaccataattcttatactagagcataataaaacaaaagagatgcaagtgtttattaacttcagccttgtatttcacagatcctaaacatgtaaacatacacctgatacactctcatcctttccgaagagagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcaaccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcgagtaaatgctctttatcattctaagcttcttactctgagtaatatttgaacatgaccctgtggattccccataacaatttctgatactgtttccctagttgatatgtttggatattttccatactatgcaggctgaattctctttttaacttagtatgttctttttcactctgatgctttgacttttgccatcatagttttctttattttcagagtttatcgactgtcactaggctttcttctgagtcctttcgccaagtcatccatactttgctcttctaatcttctgttataacaggcttcctgttacttatatttttgctgttatactctgaatttgttccagattttctggtagagatttccctacaccaaaaacagtattccaggtgcagccacttgagaattgagtagagataaatatgtgcgcccctttttactgtgatgtcttgccatctgcagttcggagcctgtaaaagttagatttgggattgaaaataagacttccactaggactgccatttgcagcacaaactcacctggatggtaactgctgtctagccgcagctccctttcgacaggtccttctcagaagacttcttttccaggcttttttcttcctgtgcatatctgtgttttcattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaataaagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttataattgcctaaacaattcatcatttgtctgacagcatttttcctttattaaatcccagttttattgacagttttcattatcttctagattgcagaagctatatgtaacaatgtgtgtgcccattctgatttctcctcaatttattactgttttaaaacctgtactatagatgataggaagagagtacgatgagaagagatagactcagaatctctatggctcttcttggaaaaacaccataatgtgtatggaagatcatgcatggggattttcctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactctttatgattacaccaaccctgaatggcacttattttcaggtgtgacactagcctatggcggctgtcatgaggattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattgatactaatgtggttcctccatgccatattgtttctctgcacatagaacaaatatggatctaactcatacttctgtgattgcctactaaattcaaacagtactttgtgtttttacttagaaaagaatggatatggccgggcgcggtggctcacgcctgtaatcccagccctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagtgagactccgtctcaaaaaaaaaaaaaaaaaaaaaaaaaagaatggatataatttaatatgtaaccttctcttccaatctttagctatgctgttgattttcttcccagtcttcagctatgttgtttttgttattgtcattattattattattatttattactgaatctagaaagaatcatggagaagaagcagtattactctgggccaggtattctttgtaatatctttaaaatacatttgaactctgttcacatatccctttgtttgcctattagatccggtcaacattatgcaaacacacaccttcatgatattgaatattgatcaatttagtcacatgccatgcaaacgtagaaataccacttaatggctgggcatggtggctcatgcctgtaatcccagcattttaggaggccaaggcaggtggatcgtctgagctcaagagttcaagaccacccagggcaacatggtgaaaccccgtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaactactacttatcaaggaatgttttgaatgctttaattctttgacttaaattactatatatatttataaaggtgtagaagatttaacaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagctatagagcttttccttgttgaacaatgtagttttcttgctcaacaactctgacatccaggtaaatggaaggaaaatggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtttagatggaggttatatttactggacatgtttataatcttcagagtgatctaagccatagagagctaatttcccaaagatcaatgactaagggaggatttcagaggttatcctctttatccgatttcctgtgtcctaatgagatggctgaaacctgtttggaatctttctgattaggaactcttgtgagagtcaataaagaatatgacattcataaatctaaataagaggcgacttggcagcctgtaggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgccattcaattcaaacgaaatgtatttgttaaatgattattatgttttccaattaagaaggatgacacaaaaaaactatattggtatatggtaaggatcattatatagatctaaaaaagttttatcaaagatgatgataatcataatagctaatgtattttgagtagttactgtgtcaggcagtgtgctaagcacttcacacatgttatttaatcctaacaaattcatgaattaggtcttattatacctattttgcagatgaagaaactgtgacttagatgcattaattaactttccatgttaacaaaatccttcccaaatcccatattcccctctcgctgtcttttgccccctctcagctaatcttctaggaaaaacttgtctgcctttatcatctctacttctttacctcccatttgtttctcaacccattcagttaggcttctgccactgccatcaaaatgaaaattaaacagggtcatcaattcctccacatgtccaatacagtatttttgtttcactggattgctcaccaccttttcccacaattaaccacttccttctggaaacagtatcttctcttggtttcttgtaccacatattcctgtgtttcctctggaatcatgagctgcttatctccatttgatagcacctcttcctctgcctaatttctcattactggagcattttagtttcggttctgggtcatcttctcttgcccctggattctgccctgtgtaggggattttaaacattgttggtaccacgtacattattggcagtctcatgaagcctatagactcgaagtgcataaaataccctggatatctctcagtatcccaaacgtagttcttacaaatgggaactcttgttttccatctgcaaatttgtttttcctccagtcttgtccatcatcaatccagttgctcaagaaaactagaagtcatctatgattcctcatttatcctaaaacacaaagcttataccatccattagcatgtcttggctattttatcttcccaccgttccagattttcccactttttccttctatccactgccaccctgctgtcaccccttaggtggtgcttaatacatgtttagtgtatgaagaaaggtttggaatggggaaaataaagagacacactgaatcactaggggacatgtaatactctaggcaagacccaagatagaacagggacagtctgaactgaagacaagaaggatgaatttaaaagataagtgtgtccagtggaaaatacagacaaagaattaagagttacaaatgcctgttagtgtaatcgggttgtttgaagctatcttttaaaaatttccatttctttttaagtagccttttacctcatgttctgtgaagtcttttggagacagtaaatcatattgtttgggaaatttaagggtggagatgggaataaaactgaaaagaggaatctttcctagattaagttgacaaagaaacagctttcttcagccatttctctccagacactagtcaaacaaacaggtgagcaccagatagtttgagcagcagctggaacagttcaataagagtctccctctagcctctccttacttctgaataagccaagttaagctacagtcaactagtcggcttctctaatattctgtattgttctgaggtttaaggctttgtttttttcttggctgtctaggctctctgattaactgagattaatctctatcatcctgtgtaagctaaaccctaaattacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatattgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcatgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccatgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagcatgacatgacataaaactaaatcttatggcctgtaaaatattcttggtttacgtcaagcaaggggttcccttttaaaatgctctttcactaagacaaaaattccactcacatagccctggtgacttttgattgaatcaggatcttttaaatttggaactcagcaagaaaccgactgtcttactttcctacagcttttgtttgaactttcagaatctaagttgatattgcggtctgctgctaaccagctctttcctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaacttattacaaatcaaatcataacataataattgatactgaacaattgctatgagaattgaacagaggaaatgcttctgctgggaaaagaccaagaaggcttcagagaagaagcaaaatttgtggttggggtgatacaatgaatgagtactagcaatttctcaggggagcagagtatgtctaacaggcagaacagcatggcactaagttaggaaaagtaccacctgccttagggacttcaacaagatatttgaagtgtttaaataatttttttttctcacttggattttggcttttgccaaacaactaacaaacaactgttacatttgatctaattattttagatcattaactttgaaaattgctgtttgtgtgatttcctacattggccttgggcctattatgagctgacatctaatgaacaggtggctggtacattcctggagttttgcccttgtcaaacacttgacccagaccgcaaaatgtcatggtagctttccctgctgaaaccttgtggacttacagctcagtaacgatgttctaatgatctaacatgctatgccatcatttgttgattcataaagtcatgagataaacactaacattattatcactgtctctttgaatgaaaattaaaggctagacttttaattttatgcagtattttcctgactcaattatttgcattaaaaaatgtttaggcatttcattctcatggacctacctcttaatatgctttcttcttaatcaggcaataatttgtaggtttgggcctcaatttcaatagcaagtgagccccaaactcagtaaaaagcaaaaagggttttttttttctgagattcaataggaaacacagcatacaaatatttcatgtaattttaaaaggtaatttagcatagatatgcatactgaagtatttaggggaagtagaaagatgtctgcaatttattttgaaatgcgtcaacaaatatgacggatggatagagggatagataaatgggtggatatgtttgaaagcaaatataataaaaatgttaccatctgagtataaaatacagctattgattataaaattattttaactttgtggaatgtttgaaatttttacaatatgtttggggagaatgataaggtagcaaagaattaaactggtagaggtgcttggataagaatgataagatacttaaagtgaagagaaatttctctgacttatcaaaatgtagacacgaatgtagttgtgtctgtgagtcaaagtacacaatctctcttctccattagcttatgaatctgtcagatgagaaaaaagatcatcctaggagaaagagtagttcactgtaaaggccagaactttagtctacttggcaatatataaatagacttttggggtttatttttaatataaaacactgatatttttcgcaaataaggccatttctgccttctcagtcatttcaacatatattgagcacttcctatattcctggcatggtgctaagcacgggggctttaacttcaaaaagttgaacatcaagaatggagaaagagaacaagaaggtgatgtcgcacacggaaagaaggacttaaaatgtgctgtgagagctctgaagagggagaagtccctggcttgttagctctgatttggggcaggctactaaacctttttgtgccttagtattttcctctataaaatctggccaataataaatgttaaactactgtctgttaaatagctggaccttcataaatggtcactaatatctttaacccagagaggaagatcaaattaggaaaaaaaaataacacagccataaaatttgtttgacagacatccttctttttcccatccctcctctataccccatcttttgttgccctagtagaatgataaaatcacagccctggagctggaacagacctagccctagattttggacagatattccattccaacccccatttagaggtgaagacactgaaataacttgagaaaagtgacttgtctcaggtcccatagctagtcaatggcaaagtgggtgaacatgtaggataataaagcttttactggagagagaggttgaagaaaagttctttggaaatatagtttatgatttcttaggatgtaagagagaaaatgctcagaaactttttttattgttagaagagaatgtgttttagtgtacctaaacacattgcattagtaggttctcaagaggcatttgttgacttgtattgcattaaacctctcctgctaattgtctgtatagcatggttaacccttgttatgtgggtaactgttcctttaattaaattagtttttaagtcttttaattatattttggtgcctgtaattgacagaatctatatctcttaaccccacatagatttatgcagttaggggtagtgaagattgcttctctctttgtgaaaatggaatgagtactcttgtaacatctctatatttgtatcttatttgatctgtgggacatagaacattttcttgacaagatagcgatttcccctagagatctgtcaattcacaactttgaattaaggtctctaggcgttctaattatcagagccaatgacccccgctggctttgacctccaatactttagctggacagttcactcagagcaaagatagaggttctttatactaaaggagaatatttcttatcacagaggagggaaagaaggagaataagagaaatagagggagtggaggggatgagagaagggaaagagaaagagagtaagtgagatgtcactgcaaaatgtttttaaattatttagttgatactattaggttggtgtaaaaatagttgtgcttttttccattaaatagtaatggcattattaaaattggcattattaaaagtaatggcaaaacggcaattacttttgcaccaacctaatattaaatttttaaaaaataaaagtcatataagagactaagcaaatccacaataaaataaataagttgaaaattagtgaatgaaataggatctccacaaacaatgctgcagaatagtttagaaacactgaaagatatttctaacatgcaatacagatcctttcatgcttcatttgagaagctggtataaatagaaaagtgaatgtacagtttcagaatctcagaccagaaaacattctagagcacaagttctaagacaaaagaaagagaggactcacactctacttgggaatgggctgatttttgctccattgagcagattgcactgttgatcaacaaggtagatctggtaagaagttgagacagagacaccacatgctgaagaatctaggctgtcggtgctttttggaatctcagaaagaggtcagggagcccttgtgactccaggaggtaaatgactttcccattgtttgctgttccttcccagcctcaaaaagtagggatgcagacagctgcttctgagggtgattttttttaaatttaaaagttccacctgggcatgatgcagttgctcatggctgtaatcccagcactttgggaggctgaagcacatggatccttgagcccaggagttcgagaccatcctgggcaacatagtgagaccctgtccctacttcaaaaaaaagaaaaaatcagcctggcatggtagtgtctgcctgtagtcccagctaccagggaggctgaggtgtaaggaccactttaatctgggagatcaaggctgcagtgagccatgatcatagcactccactccatcccaggttacagagtgagaacctgtctcaaaaaaaaaaaaacaaaaaaacaaaaaaacaaaaaacaaaccttggaaaagtctatagcttcatcttatgcattattcccccatatactgataaaattcaagtcccttcatagaacccaaacagctgataatgtggcccataattgtgaattccccaagcccagcatttgaaaagacaatttaaaaaatgagagagaaagagagtcagtgctgataagtatgaggtaatgtgaatgtgtaggcacagggtgactttgtaagtgggaagaaaaggagggagaagctaactttcattaagagtcttctaggttgggtgcggtaaatcacagcactttgggaggctgaggtgggcagatcacaaggtcaggagatcgagaccatcccggctaacatggtgaaaccccatctctactaaaaaaatacaaaaaaattagccaggcattgtggcgggtgcccccctgtagtcccagctactcgagaagctgaggcacgggaatggtgtgaacccaggaggcggagcttgcagtgagccgagatcgtgccactgcactccagtctgggcgataaagcgagactccgtctcaaaaaaaaaaagtattctgtgagccaagcgctctacttgattacttgatttaatcctcgcaaatatttttcatataacatgatgagaagatgggggttcttgtaagcagcagaactgggatttgaacccaaatctctatgacataggtccccatacattttctatgacattggttgtgtgccatctggctcatgactttccagcaatttcatggataaaagatgtataataatctgacattcaaaacccatatacttttgcctgtgttagctgctctgggtaaaactattggataaatgaggtttggagaatagatgtgaattttcattattcattcccttctgagaattgtccaaataatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagttttgcactggccaattcaaatcaaagagtttttttttttttcttgtctttggcaggttttacaagggggtgtccctgaggggaggtgaaatgagacctagaagcaatttttactgtaacacacacatacccatgcactaacttgctttcatatagttacctgtacatgccacatttcatgattaaaatgcagtccagaaaaatatggtgcactgggctatgtatgagtcccattctctttctttctatttttaagtggattttatgttgcctatttagtctgtaatgaccataagccactccagccaacttgttttaaagctcagagagaagtaggtcactaaacaatagaataataatgtggccacatatttaactttctagtacccacatttccaaaaagtaatttcatccaaaactatcatttcaacatgtcattaatgtaaaacactgttaatgagatattttgaattttttagtggtaggtcttcaaaatctggtgtaaatttgcactgacagcccatcacaattcagtcaagcccacatttcaagtgctcagtaaacacatttgtctagtggctcctgtattggatgacacaggtgtagactaggaaagcattcactcatggtgtttattcaatattttctctatcttctatcatttcttatattaagttgtagagagagagcgcactatttctaccccatcagagaacatgaagggatgcagagaagaatatgttgagttgactacctacctcacagaggacctctgcatgacatttagttgaagggaactgccttctctttttccaggaagattaaatctgtatcctctctgccattcagtttaatacctatgtgcaaggcatcagtagagaccagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatgaacatccaataaaaacctgtttgtgtttttaaacaaaattaaaagactaaaataagaatagaatataggaataggaagaaagccttacatgacaataatcaatttgggtaccattttgttacctcctggccttctgcaacttaaagggaaaaaaaaattaccaccatcaggcaaatgccttatcatgataggacaaaattcttcccattgtgtggctctgttggcatttttaaatgtgtcatatgtggctgggttgtggggtacaagatgtagacttgcttaggagacaaagaccagcataaacttttgaggatccatcctacatggagaatgtagtgaatatgctattgctctaagtggagacagagtcttgcatggcaggaagcttcctaaggtgaccacttgagtcatgaggcttagaagtctttgcagaagagggaaatgagccttcacattaggaaaatatgctttactattacataagttctgggatcaactgatacaaaagttgggagaaatcaaaattttaagtttttcctatgtgtgtacctatgatacaatcaagtttttattcaatttataactcctgaattcattcatcaggagtcctttaggaagctaaacagaactggcaggtctgtcatttggatttgtcatgattgtgagtatttcgttccctgcaattaaaaacgtctgtgggacaacaggatttcaagtcaggagattgttgggtccttgcttctgctacttagctaatctgtgactttggaaatcactctctgaatgtcattttgtttacatctattaaatgtaagctctctctgatagcattatgatgaggaaaaaatgaaagcatgtgtctgaagtatctggtacagaggccagcacatactggttgctcaataaataccagtttctttcccttttactactctaacaatttctcgtttgtattttctgctcctgagctctgtgtcttgaaaagttctgttggcatacacattggacttgattgcttacattaaaattatctattcttgtctctattttgtattaatgaatacaattaatctgattacaagtataaaactatcagtcaggtttctaaaaagttattaaaacatatatgtattacctgcttcccacattccagtgccaggctctgtagaaacaataatgaataatacagctattgccctaaagaggcttcaccaatcctgtctgtggttcagcatcaccaggcaataccaatttgtcatcatcatgctgaatggggagaggtttagaataatcacaggagaacgtaagaccagctcctggccccgtcttgatgggtcatgaaagaacaccgggtactatcctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcctttagaaacaggtctgcaaaggcagtgttgcaaactaatccaagtgaaaaatcatgggagacttaaatgaaagcattcctgggaatgaagaaggcagatttagtaggattactaatgacaggttggatggaagatacaaaagagaagaaatctatattgctgtgatccattaagtctcattgtctacttttaacacttaatggggtggcagtgttgttattctaggctatcctttatgaggttggggttcttccctgacagttgctgaggctgtgggaacaaacgagttcatatagggagtgagtgaggagggagacttcagacgctcagggattctacaccatggaggaggctatgaaggagatccattttcttctaaatcattctgataggcttctggatggctttcggtctctggccaggtgctgatggaaagctctcctctctgatgaagattaatcatcaaacccaggagataattttattctgctcttctgagtcatgttagattccagaacaattaactttattttccccaaatcttgtatctcttgggaatcttccagtaactttggtttccagtctacggagctacttttggcagcttgttgtcaaagaagtgataattcttaaagcttagagtgctaaactgcaactcagttgagaattgaaacctttccagtaaggggctcagccccagacacctgggactcctctttctcctttcaccctcaggtacaggagtgttacataaaatggcactaatccacttttacagtttttgtgttattaagcaatacattaagatttaataaccataacaaaagggttgttttctcaccaagcagttattatttgttgtacttctatttctactcatttaccttaggtttgctttagcgatttcaatttagtaggtgtctaatgatatgcctgtcaatgaaactttagagatgactttcagtccttggaatttttttttcatagtttcaagaagcaagacttgcgaagatgatttgcgttaagaggtttgtgtgagttgagtgtggacttaaattaaaagtaacttaatttactcagagtagtagaatctagtgcatttaaattggttgagaggtgcagacttcgctttggaagtcactgtaaatcgatgccgatagagtaaaaagcattctctgttctcttgctgttcctttttgaagggttcagaaggttggaagagcatccaaatcagtataatcagacctattagatcctagcaaagaattttaaatacatacatctttttgcatattgattctggcaatttaaccctcagcttaaaagcagaaagttggttcaagtgaatacaacatctcactctgcacaatattaagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttaaccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatcttttaatgaagcataatgacccatctgacacatatataacaacacataataaaagataaaattaaatttgtcaaagcaatatagaccacccactactagtagattatgtttgggtttggattttcatatattttatccatatctgtttccttctattgggactttatggaggcattactcatgaactttggcagatcttttttggtgtgtctgaaagaaaatcccaaagctggttactaagatgtttgaaagtcatattcttcttcaaaccgtgtagaaataactatcaggaaataagtggttataattttaaaatggcatgtttagggaagagaatatataagtttgaaaaaccgcagtctcctccaatacatttctacctattactaacagggtcaaaattgtctacagaaaacaacctgatctcaatttcctcagacaattcagctagtaaaatggtgtgactgacctagagttacggagataactcctactgctgagctctctcaacaagtgacaccctggttgacaaacaatcacacattatttattaaacttctatttaataacaggagttatggagttagcaatgttaagtgaagagtccttgttttcaaactttgcaaattacagttagtaactaataaactaattaatgtcctttatgaagagatgctcagtgatggcctgaaaaatccctaaaggagatagggagagaattgaagtatggaataaaatgacctatatgggaccttcaaacttggagttttctatattttcaaaaattacttttgctgtcatttaatgtccaaatccaatcccttgtctagggaaccagttcggattaaacaaaatttcaaaaatacacaagcaatcaatatctaattcatttaagtcctgtttcttcccaggactgctgggtataagcctagagttgcctgccatttctcttatattcaaacactttgggaaaggagccatttttttagatctattttctccctgaagcttgggagctatatctatataaaatgagatgacatactagggctagcgtactaaaaccttttctaagagaatcaatatagctttgagaagcctcatttatatttaaaggagaaaagagacataagtagaagtggacataacgtatcatgtagacattgaaaaataccagaaatgatttaaaagtgactgcgtgttctcatattcccagtgccttgtaatttgacttggagggatgttctagatctccattgaatgtgctcactgagatttgtctttgtcgtattgattacaatcatctgtcaatgccctcaatattttctgtactgaccaacagcgacacagatcataggctgtaactagtacaggctgtgccaatgaaacaatagggctaattagcagacatgaaaatgaatcactgatttaattttcctcctggtctaatcaacacaatgtgtcagctaaatattttgatccattatttcaagtgaatagaatgtgcttttatattatcatttcaatttcattaccttgaatattggaatttttgatttttggatacatcagtgtccagtcagtatccagtgatttttagatacattttggatacatcagccttagcatacatcagtgcctacgggtataaggcactgatatgttaataaacatattaacagtttgtaagccaatgaaacctataattattgcataatttaaattaacttgtgtacaaaatgccataatatttccacatacgtggtggctttcaaaatcaaaataaggtgagcctatttcaatttatgacagacaattgtatatctcctctcttttctttgccaaagaagccctttatttcatcctcacaggtgttatacttgtctcctttctgcttggtgaaacaatcacggtttgtaatttcactttctgaccatcaaatacgataaaatgaaacagtttgtgcttttcttgtactttccgctctcaggggttactggttgagagagctcagcagtaggagttatctccgtaactctaggtcagtcatgccattttaataggtgaattgtctgaggaaattgagatcaggctgttttctgtaggcaagtttgatcctgttggtaacaggtagaaaatgtattggaggagactgaggtttttcaaacctacatattctcttccctaaacatgccactggctggctgggatgctaccttataaatgtgaggtagatgacaccagtctgtaactctagacttctgtcatggatagcaggataacttagactgagagctgtctgtcttcccagcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacattgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgatggtgcaggcctgtagtcccagctacttgggaggctgaggcaggaggatcgattgagcctgggaggtctaggctgcagtgagccatgacagcaccactgagccttggtgacagagcaagaccctgtatcaaaaacaataacaaaacacagcaaggaccctattactctcaatgggaaaaatcgcagttgcttttgggccagcctaataataacttgacagagagaattttattccctgcaagctacgagttcgttttctttaacagatgaggtaactgagccacataaaaattaagttacttgtctagagacacccagctgataagtaagagagcagacatttctactcaagcaatctgactccaaagctcatggtgatgaagcaggtcatgaaagctctctttatgacacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggcatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcctcagcttcctgaatagctgggattacaggtgcacaccaccatacccaggtaatttttgtattttcagtagagatggagtttcaccatgttggccaggctggtcttgaattcccaacctcatgtgatccacccgccttggcctctcaaagtgctgggattacaggtgtgagccactgcacccagccagatgtcttttttaatatgatgatttattttcttttggataaatacccagtagtggtattgctaggtcaatggtagctctatttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcacgtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagagagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaagaaaaggagaaaaaatgtgcaatgtcaagaaacatttttgtaacttatggtcaatcttgtgtttctgcaacacctatatcttaccatgtagaaatttagggatacaaaccacaaagattctgagggcctaatcatctctcctagacttgcttttgcattctggagtaataatctggaaaagcaataagagtagggacatatttatgattattcttaaaactgtgtgtagaaaaatacaagaatatctactccaaaaacctgcatgaagacatttgatagttagccaaaattcaagagactcctaatctttgaaagctacacattaggctggtgtatatgtcccattatttgaaattgcacctttaaatatttgagacatttatcctattatccctgattacaatttccccactacaattcactgcacagtgcttccttagggagctgcttaatacatttcaatcttagaaggtcaagattccctcagccaattccaaactgcattgtcccattgaatagatgtggcacattctggatctagtgagaataacctatgtatattactttgaagtaatacaggtaggccattatagcagaaagaagttgagtaaatgttgatatttaagaaggttgataaaatatttgaacacaactgcaatccatacccaattctcagtggttttttttatagaccatgaaatcatagctaaagtcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatcttttttattctttcttggaggcatggaaagcaactcaaaagaaaaggagacctctatagtacatccgcactcagccttggatagtgagaagtactcaggtctgagtagcctcagacagtggagtcagaagcaagatgaactgtcagggattataataggaatggtcagggctgaaagcaaggcaataggtcaaaacctggcaacaaggaaagagccctggataagtagtttccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgatactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcagcttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaataagtatgcatgcaaaaataagtatgcatgaaacataagttttcaaatatcatacactgacattgattaatcatcactagctgtcaggagagagtgctgtattgagaaggatttagcaacccagaatgtcctaactggcttggctcatgtctgctgtgggtaaaggaaaagcagggagtgctgacaagtctgctttgtatttgccaccctttgcaaataggtactcaccctattcccaaagagctaatataaattacatatcactttatttgtgtttgatttattacataattattattagaataattcacataattataaccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagaaagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgcctttaacatcacttgcatgtaagaatgcaggtctctatgttagaagagtgatatctgctcacagcatctcatctcctcctcagctctcccagcatttgagcgctctctccgcttcgttttcaaccatggtagtctaatcactggcaaaccaccagtgagttgattgcagccctttataattcctgtgtagtgagatgccataatgacttttccaggagtttccacatcatctgtttactccatgtgacattccttccatctgtctactttcagtttattttactttattttttagtaacttcatatcgcagatgaaagtactgtgaagtttcttctcaaaaccataatatttttgttacgttgcatgataacctcaggaaacatgaaattctaagaatttaatactaatatcattttgggatcattttttaaagcagtaaaagactttatgttcatgttgtctcacttttcagaggaattcatagctttttattgatgtaagccatttcataaccctgtcaaggtgctttgaggaagaagttaactgattgaacatcaacaaatcctggaatgtttgatactaatgatctcagaaggggccctgcctgatctacattccacctgagcactccttaccaaatattgctcttgccttcctctgcagtgattggttctgatcactgtagagaaagcatggaagctcattttacaaggctgcatgtgtgtctggctgctacctagatgcatgtccttcttgcacaggtcaatccattctctggtttttctctcctttgctctactcccttacacagaaacctaatttacctgtttctttcttaagctcttcatttcagaaaaactcaataaggaaaattaaaaaacccctcctttaggatgtctctcttatttctgccagctttttgaagtatgtgtgctctgggcaggggtggggacaggaagtgtatgtgacaaagatcagtcagacaaaacactcctggcatgatttccattttagagttgtgaaactgaagaatgggcaggtaaactgatattttctataagttgtgagaccatgattcactgatttgtttaccttaatgaagcatacgtaaaataattgataaattattttatcaataatttggtaatttcctcttggggctaattgaatatagtgagtataattgagtatacggtgggtggctttcaagcgtatctttccaactttcactattttagtaccctggctagaaaatgataatctgatagtgaaaatattaattcatcctctacaaggttctgaagatactaacttctcagtaaattcagatatagattacaaccattttcaggatataataaagaaggactaaaggtatctctttggtatgtggttctttacggccacataaatggcttccaagtcttcatttccttaagttcatttcctgctaccctatggacattgctaccctctccttctctgggttacaaataaatggttgatggcattttaataacaaagattaaccaggttgccatgttaaggatagatgggagaagcagtttgggaaggtagcctagacaaggtgatggtcttttcaggaagttctcaggtgtctacaataggtagcagaattgggcctgagcaaaagtcacatgagcttacagcaccctgtgcagtcaaactctcaacttcacttaagctttttctttgctttgcttctgcccactcacctggcctgttaccacccactgttttaagcagctcttcagctgcacatctactgtcctgctctgccctgaaataggatgataggtaggactgctgtacccacagtttacatgtccttaccctccatgtaaactgtgggtacagcatttgctacctaccgtgcttctcaaataccggaagcatggtttggacagctgaaggcttagcaatcattccaagctgcagcatctccttgggcctcaggctaacacccatatcaaaacaacttgcgcggtggcgggcgcctgtagtcccagctactcgggaggctgaggcaggagaatggcgtgaacccgggaggcggagcttgcagtgagccgagatggcaccaatgcactccagcctgggcaacagagtgagactccgtcccaaaagaaaaaaaaaaaattatgatatttaaagagcatatttaaccattaaaatagtaaatatgttgctttttttttttcttaattgaactgtagtgtccttattgttttaagacttcatcgtatattctggatacaattcctttatcatatatgtgatctgtatgcattttttccaagtctggcttttcattgtctcaactgtgtctttcaaagagcaaaaattcttaattttgatgaagtctgacttatcagttttctttttagtcaattttgcttttgctgtagtagctaggaaatctttgcctaacacagtcataaatattttcattttttacattttgtgtttaggtctcccgtgcattttaagttaatatttttacatggtgcaaggtgtatggattaaggtttgagaacagacagacaggaatgtctttcagatttataaaacgtaaatgctatatagttaagcatttaataatcttttctgaaaaggaaaaaaaaatgcctacatttgaaaccattctggaaaatgtaagataatgtggttttcctaaccaacagtagtcagcttttaaatgcagtactttgactttattatcttatcattgagattcaccatgtttttatgtaccactaagaaagaaaaagaaaaaaactgattaaattgtttaaaaaaaaacaaaaaccttgaagacaattttagttacctccaggctaatcatttcctttttcttttctttcatcgcccctgaaactcccccaagcattatccaaggtgtgggctctttttggttagtaaacttcacttgtcatctcctttgagtgtgcttccccactctcgtcatcttctgctggcttaactcgaagcccaaatttcttacttgtagatggttaacaaatattccacattctctgcattttcttcctgcatttggaacctgggtttcctttaaggacaccaactccttgaagtcacactccccctttctcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaaatgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaactggaactgtatctattatcctttctcaacaagaacctctcatatctcagcatccttctaaggctcgcttactatttcacctcttctgtacttctaactttgagccttttattcccttcctatttgcaagcttcctaggcttcatttttaggaccccaatgttgatcacttgaatttccctttcaccagctcactgactctcttggcctttcaactcatcctttttacaaacccctggagcaggtctctcatcgcccttcaccactcctgcagccagtcagaacagctggtcaaatgaatacaggaatggactcactcattcataccaacggtgttcacttgacctgccataacagtgtgattctacaggccctgcaagttcatgctgactgtatatctcactcttctgcctcagagctagagaaaacaacactgaaaatgaccaaacctcctaatcaggaactggtaaattaaactgtttaaaaaagttctctttatatgtgtacatacataatatataacttcacagaagtgagcaaaagtgattacactgtatgtataaatttatggggagaaatgtagcatctgaattcttttcctttttggtttagtttccagttcccctcttcccattctccacaccaacatcatccctcacctcataaacctacacctagaaaaactatgtcaataatctagaatgtatctgggattttttcccaagttcatatgcttaaaaatatatacacactcatacatataccatcatatacttataaacacacaagcatactgtggatatacaggcttttgggctttgttttaaaagatgagatcataatatacacatcttctgtttcttgcttttgtcattagatatcttgtagatatcactctagatgaaaaggttctaactatttttagatctaattattaacttgttcctttgtataaactcgtaaatatttattgagcacctaccatatgccacactgaagcctgggatttattcaaatttcagaattgagaagggagtagagagattcatagtccagctctcttacagaatagatggaaaatcaaggctccgtaaatattcgtgatttattcaaagtcatgcagccagttgatgccatgtctcaaatcaaaatctagctcttgctagcccccaagtccagtcctcttttaatcatactattcagagtcccataaattagcatacaattacttacaatttaatgtgaaaacatactacaacataagataaatcttcaggcctggagtagggagaggatagggaggggcaaggattcaggaaatttcctgataatggtttgttgtctgtgtggatagaccaaattgtctttaatgaaccaaatttatcaaccagtgaagactcattaagatgcccagcatttaaagggagatcaataaaagagagaacttagtattgaaaagctatgaaagagctttgaatgaaattcactctccgtcttagcagagcgcttttcaagagtgagaatcatgggtgggctgtgagggaagatattccctggccatctaagcacatctggaaaggtccagatttcaaactgtcgctcttttgtcagtgctgaaaaacttaaccttgagcgctaggaagatgttctccaagatgctgaaacttgtcacgttatatgagtcttcatgttcataggcaaaacaaaacaaaacaacaggcatatacatgacattaccttcttttttgtttgagacagggactcgctgtgtcacccaggctggtgtgccatgatcctatcatggttcatttctgcctccaactcctgggctcaagtggtcctcccacctcagcctcccaagtagctggaactacaggtgcactaccctgcctggctaatttttttctttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtaccctgactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgacaaaatagcgaagaatgaacaaatgttccttaaagccagctaattctttggttattttaaagctgattggatcttttgtacacattctaaagactctaaagagagtccttgaaggcataatttcactgaaagacatgcaccacaaaccccctgagacatccaactgcagggaacacctcagctcagtcagtatgtgatgagctttcatgtcgcagggcacctgacagttggatgaaaaattgctttcagtctatgctgggttttctgtggcagttcagaagcaggactaggttctgggtctttactgtgtatgtcatcttttctttcagggttctgtgtttccatgcaaataattataatagtgtagaattatttgatacctactaagtgtcagatttcctgccatgtacttcacagacttttattctgtacaacaacattatgagtcatgtaatatcatccccacttcagaaagaaggttcggagaggtggggtaagttacacaatgacagaactacaagaggcagagcaggggtgaagctcagatccccgtgtctccaaacccaaggctgagaccgctggctgcactaccccacacagttctgaggcagaagagaatcaggaggtgaggatgggaactggggaaggggttatgttctgatgagttagtttttaaaggagagccagattttctgaagcagaattttaaacatgaataggacatgttaacttgatgttagtgaaatatttcctagagttggggtttattgttgaatactaaactcatgggagtactgcataccactgtggaaaggtgaacagaatgactttagggaatgtgacagtttacaaagaaaaaagtaaagaaaggaaggaaaactagaattctcagtcctgaccaaaactatctctaggataattatggtttatctaaaacttgtttctctgggtaatcagataaccctgctctctgtgagtgtagacttctccacatgctgtatgaggatacctctgtgtccctgtagttaacaattttaattataggtgaagtattcaggttaagtggcctaaattgacactttacatggagaaaaaagtctctcatgagactatatgctataaatacataattattcatatttaaactcaacattctattgcttttatatttgttttatattcatttttcacaaagtttcctttgcaattgattcctgggtgatggtattaacatgtcagtattatttattcaagacaagtggaaaatctcaagaaaaggctaaaagacccttgggagcttacctagtgactacaacagaactaggaattaaatggctgtaaagtgacatgttgtatacaacacaacataatttattatgtgttgcattaatataggcgttttgaggatatcaacattagctgaggaatcctgatgtctgccaattaccattgtttggtaaaagattgggagttctggatttaactgcttggtaatgaaatcaacggtttgcttcaagttaatgttatacagtagatgcctagctgatttcttgtttcccctactatctaccttaaacgcattctgggtctcccttcatctttgtaggtttctgagctatttttgtactgtctacatatcttgattagctaatctgtatattaaccatatgttctgacaagagttcagtgacatggaccctcagcccatgacgctcactaccactgacatgttgcatgtgagtggtggggggagatgaaattagtttattataatatgacttttgagaagatatagcaaaataatcctctaatccattctacagaaaaccttttgtttttccaactttattacctttcattattccatctcagctgttttcactttgtgagattgctagggtcaatgggtgaggatctgccatgggtgtgtgtgtgtgtgtgtgtgtgtgtgtgtgtgtgtatgtgtgtgtgtacttttcactgtcaattattctaagaaaagcaaatgctaaagtgaagtgaaacagacaatggttcacagtaaatatcaagctgtgtttgtattgctgccatctctttgggagaatttcttatctgttcctacagaaaaattactggaaatatatatcaatgaaaacgtataaatgaaatcctgaaactatataagattcatatctcttgattatccaaaatagagacatattattacttatgaagatgaaatgtttgtggtttgatgctaaaacatttagtactaataattattccatatagagtgtttgcattaatctcgactacactaattcagagcatgagctctttgcctttgtgcatgaagacagtttcttgggcaaattaccaatgtaatttcctcgttgtcattccgcaaaccatctatgttcaaatattttaaaagcagctgtacagaaccaaataatttatattttaattctatataaatcaacatatacttctttacttggacattaccattttaacttcaaattcaacatgtctattttgaaacccttgatttccaggataaatcagtctcttgctgacttcccttctcttttgtttgtggtagaatgattcccctaatgttggagccttaaagtctaacttagtgactcctctcatgttttccatatctagtctggggcaacatccagaaattcttcctgttctgtttttcaactatctttttagttttatttctagtgccgccatctcagacctctactaattcattggaattatttttcatctctctgtctaccatttttttcttcttccaattcatcctatgcatcaatgtcactctattttttcatatctgcaaaccactcagtggacatccaatatacaagcaaaccaattataggtgaaatttaaaaatatttattgtaatttataaaagaatagtaaactaaaaatgaatggtaataacagcaattataataatggaaaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatatatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcatgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaacctttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatataaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcgtcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaattaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcagaatctttcaggaaatgtcctttagtctctggtgggaggtgtactgcaactaaccgtcctttgaatttatgttgccatgtacagtccctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgctcttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagtaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaaagtatattcttggtaaacaacttaggaactgcctcttgtttttttcctaaaaaaacccacttgtaatggctggtagttggagtgtataatcagagcaacttgaatctacgctcctgagtggccatcttcaacaatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttacaaaaaaaaaggaatatggtgataatagagcctagacaaagggatattacccagttagtagatgtgtatatgctgggcaaagggattgatatttaaataatgtacaggagtcatctaatcaaaatggtagaggtggtgggtgaggaaggatcttttgtgaaaatggaacaacatgtataaatatataccatgatgggcaggagcacagagattttgagaaaataaagctgtggtcgcagtcacagctcaaggagacagtgggagaagggaattcggtgaactggtaaaggtggcaggatcatttggtacctcataggctctgattaagattcttcctatatctttagagctgttgaaactcactggagtcttcaacaactgagtgacaggattagatttgaaaagatcattcttgctatggtgtagagaatagtcattcttagatcattcttgctaagtcttccatgagaaagtgagtaacatagatttgaaaagatcattcttgctataatgtatgaaacagttgggaagaaggtaagttatgggaagaccatttgaaggctatcacaaagagaaattctgatcatttagattaggtgatggagagaaaggatgaggaacccagaagatagtgggaattaccaaggcagagatgtggataatacagtccatgactatagaacaggaagtgctgaaagagcatgtttctgcacatttagaattaagagggatttggagcatctggagcagaatttgtttgttgggaatgatgactcgggagaggcaggtaggggccaaattatgaaggtccatttttgtgatgtgatggcaaaaggaacaactgaataaattgagcagggaatcacagtcagatgtggagtccagagaagtctctgatggtgtggaggatgctccacatctctcatgaaattaattgagaaactgctatttttttcatctaagagttttaattatctttcatttagttcccagaggctattgggcataggcacctagtaagtaactgttaataacaacatgcttattttgggcatggcaatgtggaaatttattcctgccgagtaatcagtgccagttttatgctggcagggttttaaaagaatggagaagggattcttttgcctccattaggagaaagctgtgccttctcttcatcatatagtgactcattcaaggttggcacaaagtaactttaatcaattaatgtgaataatatcatacctttttaagcctaaaatggatattagaggctatcagccccctggaaaaaagtctgcagaatatttttctttcaatgataatgtcatatatatcatagcccttgaatctttccaaaacatttagtcaatactgaaaacatccctagagagacactcatccaatttctcacatgtgaatcttttatctatctttggaaaattttaagaagtgcttaatttcagactgcttttataaaggacataactagtagcatggtaaaagtgcagtccatgaaattaaattcctgatctgaacctcaggtcaattaacttctaaaaatactctttttgagacaggatctcactctgttgcccagactagagtgcagtggtgtgtgattatggctcactgcagcctcaacctcccaggttcaagtgatcctcctacctcagcctccagagtaactgagactacaggagtatgccaccaaacctgtctatttttttaaatttttttgcagaaatgggatcttgctatgtttcccaggctagtctcaaactccagggttcatgtgatgtgctctgctgggtgctatactgggctgacaaaggtgaataacacctaattcttctccaaagagagcgctcttcaactgatgagggaaataaacaggagagcaggcagtgaatgatagagcagtatcagaggtgctaggttgaggatcttcacaagcttctaagtcaggacatcctaattcaaaccaggaaggatcaaagaagacagtaaagataatgaccacaagttgagtcttgctataagctgaatctggaagatagaagtgaaattgtccatgaaaaaggaagaaagaagaatgtcgaagaccaaaggggaaagagagtaagacaaggtaaatcaccttttgatatcgttgctgagttgtgtgaaaggctgtcaaagtgggcagaagtcatgttcagaagagttttacattcaaattaaggagtctctgttagacagctttaaatccatgtgtctaatatcttacaaagaccaaagactcatagtggatatttccctctatctaaaaataataaacttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattttgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgaggaactgctaggttagaggccccattttctgtgtctggacactggagagaatgcttgtgtttggtcctccaattaagagctgcatgatgcctgtgccctgcaatgccaacacttattgggaacccataacctttgcttctccaacttctccagccaagattatgatgaaaaaagaggcaaaccacaattgccaagtctgttctcagcaattcgttcactggtctttcatcattaggcacattgcccctgtgtacctttggtcccaacgcataaagggatcttgcattgtaagcacatcatatgtttatttaaagaattttgaatctttgcagctcttattgactgttcagcagtgaaattagctgttgaaaagcatttgcactgggggtcgtttctggaaagaaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctgtttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaatttttaggcaaaattttctacccatgattagcgagcatttatagaaagaagcaataagttctttcagttgaatacacccagtacctctaaaaattaatgtaaagagcacatttcatggtcactaaaagaagggtgcaatttaatgtatgatgttaccatttattactaagaggacctgatacacaaaaatataaattactttttccatatcttctttcagcttcaaatgattttgattttttttttactttagatactcagagtagaatttataaagacatttggggagtatttctacctcaaaggaaaacaaaaatataatgacatttaaccatttcagatatttcatgatatgtagttagttttgtgtatgtttctactacattaaaatatccaatttattggttgtcttgaaaggcttttgttttctgcagagattggatttccaaatatattaaaataattgcagtatttatattgtccgttcttaggggctgtacttatattgcatttctttgcagagttattgatgatgtatccttgttctgcagtatggcacttggcaaaacattgcttcctagtttgaactctccaatgtaaccttcagggggaaatggttctagaataccattgcatcaactcttttagcaaattgcattattagacatccatttataacttatcctctaagtgatctcagtcgaatcatttgctgtcttggtttcacttctatgaaatattctagagcaaatgctgcccttgcttgtgtcataggactgcagtgttggatgccttctgtgaagttcatttagcccctcataatatgcattccatgtaactaggagggaattttctttgggtagatttctcagataagttgtaaggggtggtgtgactggctaaagtgcatcagtaagagatcattggcttgtgaggagtgcaaaaggcaggcagacaaggggaagaggaagtggaagaagccctacacatattgagcaccagtccacaccacactccccatgaagcacttttcatacattgcctcatgtagactttgagatgactctgaaatctgggtgttattagaggccagagatctcaaaaaacttgctctagacacttcatacaaccggtaaagggtagaattggcatttgacacaaatttgactgcctcctaaacttaatacattttctgcaaagttattggagacaatggagcatgaaatatttcttagtttcaggggttgaagtatcatctgcacttagttttcttctcaaataagataaactctaaacaacaataagaaaagtagatttgtgagttttgtacgaattggccagctattaatatcatttggcattctaaaggaagaacggctgaagtaaaccacaggtgcagatcaaatcttgatgtctgtttcactgcaggagacaaatagaatctctctttcttgtatgcttctgttatgttgagtctaaatctgaggtaatcatgatcatttcaacctgaggtatggtttactaaattaggagaaacatacaaaagtttgttgacttttaagctaaagaaggcaaaagccataagtgaaacaattcaagtagagtgctataatgtgactgtttctaatgacaacttgaattgattgtaaaataagtctggcagttaaaatgtattagtgttggctgagcatggtggctcacgcctataatcctagcaccttgggaggctgaggcgggcagatcatgaggtcaagagattgagaccatcctggccagcatggtgaaaccccgcctttactacagatacaaaaattagctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaacatatatatgtgtgtgtgtgtgtgtgtgtgtgtgtgtatgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcatgtacacaaagaagagagcaatagacactgaggcctacctgaggatggaggttgggaggaggatgagaatcaaaaaagctacctatccggtactatgctctctacctgcctgatgaaataatttgtataaccaaaccccagcaacatgcaatttacccatgtaacaaacctgcacatgtgcccctgaacctaaaagttggaaggaaaaaaaagggatagatgttagattattccaacctcagcattttaaataacctctatgactttcttagataagtaatagtaataccaaaataattagagagtggtagagttccatcaccaggtctttaccttcattttaggaataggttaaggcatcaagagataaagtaattaataaaggattatgctgtgatctgaaacacaagtacagtatttgtatttctgagctaagactaaagtccagatttctttcatttcggtgcttgttcgtttataccacactgccccaaaggacactaactgtaatagtactttgtcctgacatttaggacgcactcacacccttttgtccagatgtttctgtcttagatttccttactaaacactaggattgtgaaacctttcctttcctttctagggacaaaatggtattcactggcatatctagtttaatgctttgcgtacagggtgtgccacagacaattgggttaatggttgtaactggttaattgattgacacttaattttcagagttcgaccataactaaagagagatgagctccttgaggagcttcccactcccctagtcctcttctgctgaaaactactgggtcctcaatttttcctgaatacaccgctcatgtggccacccctaactgacccagttgaccatggatccaatttcagccactttgtggattggccaaaactctaaaaggaagcttaccatcaaaatttctgtccaaaaaggaatgatgaacaattatctaggccaactgaattcttctttactctggtactgaaaacatataaaagaaaggaggaaatctgagaccacaaggtgggaagggttataagaatttacagaagtcacaatgatgagaaagcagaagatatgaggtggagaaggtaatacatacatagcaaagaagttgatatcgactagatatggcagctgcagtgaggccagagatccactgaattgctgcatatcacaaaagtggagaaataataaacacatgattctgagggaataagttagcctgtatacttgaggtgccttagatcctatgcttttccagttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgatgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaagaacaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcgtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacattacctttggcaatcatggtattccaggacgtgccaatgaagttggctgaatctgaatggtcttggaagagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaatgctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaactacatctccaaattcctgatctaggtaatgctgtttcaacaagctaagttgcatttgaattttgaaatacccactctagattgcaattaccaaatagttgttatgtacccaatcacaggatatgcttttgaaatttttttcattagtacatggaagagagagttttatattgtggtaggtagaaatgcccagacaagacaggactgagataaattaatggccagtccatttattttgataaacacaaataggactaatgcaccttgagctttaggaactagcagggcatttctagttgcagcatagtcacactaaggtgcaaagagtcaatggacaagcaaaaatgtgtaagaagaaaataagattctttgtttgttttctttatttgacatatttaaaagaaggcaaaagtgtatcttccaaaaagtacattttgtggtagacacttttcctctgctaaaccatatgacatcaagtggcatcccttttcttcctttgtggtcattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcctccatcactgtcatgttagctgttgtttcagaaaagaaatacatattgtagtagttttaatagaaggagtaggacagtaaatgtaaatgtctgtcctaatggattgttttatacattagagaacaattttttaagtgatcgagtaaacaaagtccccctcctacctccacggtgattgtttctcatagatgaaaacagttttctcatcctgacgacgacaacaacttcttcttcttcttcttcctcctcttcttcttcttctctttttctctttctttcctctttatttttcttctttctttcctcctcctcctcctcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggagatgagggaagctaagctcaaggtcacattctgctggaactggatttgacaccagagctgtctgattccaacacccacactcttccctctgccatatcctgtgggtgtgtatcaagttttctcccttgcctgtggataggttgcctattttttaaattaagctcactctttatttctttccttctccctcctccttccccaatttcccttttctccttctctttctttcatttttttcccaagatgatatttacctgcaatacactattgaaaatttctctatgcttctgccctgatctaatacaatttttatcaagggaaaaataacatttactaactaatacctttccctgtagaacctgatagaaaataaagcataaaatttaaagtttatgacacactgcaattcatccaagggcgtctaaatgttcaaagaggcacaagagagagataatttgcttttaaaagaaaatgaggccaggctcagtggctcatacctgtaatccaagcactttgagaggctgaggtgagaggattgcttgaggccaggagttcaagaccagcctgagcaacatagtgagatcccatctcttaaaaaaaaataaaaaattagccagctgtctatttaaaacaagaaagaaagaaacagaaaatgggaggaattcaacttttgattagattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactagaaagactcatctttttctgaaaaactttctaatcatatatcacttattttagttccacatttgaaagcactgttgccacaaaatcacctattcttttactgattttattaattaataaaagacattgtgtaggacagtatatttgtcataattatgggcagatataagcattagctccattgcaaaataggattaaaactgaatgtacagtgttgtcaagtatgaaatatttttcccagaataaatgagtagagaagcatttaaagtctccaaaaactccaaggggcctaagtgggctctcttccaaaaaaataataataacaagttatgatcatattaccctgaaatagattcaattacccaaacaattagtcagctaacaaatatttatcaaggctcactcttctaactgatctgggatacagaaggattgtaagaattagtatcctccctaatggagttttcattctagtatgagagacaaaagtaacacttaaaagctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgaagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaataagtctcattagatttgatggttttataaaaggcagttcccctgcacaagctctcttccccaccactgtgtaagacatcccttttctcttccttcatcttccattttgaatgtgaggcctccccagccaatgtggaactgtgagtccattaagtctctttcctttataaattgcccagtctcaggtgtgtctttatcagcagcatgagaatggactaatacagactccatcacagacctttgggctaaggactttacctctaggcacctgccctattacttctattaaatggtgtaaacacagtttgctcacccatgcaattgccttactgtgattcatcttgaagtctagcctgatgacagggatactatgcaccccacaaccaaccctactgagtaattggctccattaaaacaagagagaattgtgagataatctggatagagttagagttcacaccaaacatagagtttccaatttaatggattagtttcatttttgcaacattcagtactgataggatgggtcaattttggcagggtctagttgccatcttaaagcgaggtacagggtgctatttagagcactttgcagcaacaaagaggacaaggtttgaggataattctaatagctcttatacaaagatattgaaccaagtaaatttataatatgtgggtctgcaaagtattcatgtttcttgagaggagtgcttcagattgagagacgggagcaatctgtaaagaaggaacccaatggatggacactggggaatgaatatcaaggacacagttaggtatgaatttaagctagatgttcacttaggtaactgtagcctggagtggaatgacaggttagaagaagtctcctaggctgggtgcagtggttcatacctgcaattccagcactttgggaagccgaggtgggaggatcacttcaggacaggagttcaagaccagcctgggtaacataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaagacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaatataaattaagatactaggttttaagttaaaatattaaattacctctagcttttaaaaatcataaagatctttctttaactaacagtagagggatctagtgtttcaagtattgaattggtttaactgagcaatttctgaatgtcaaagcaacagattctctaataacatcttttgtttttctaaagtttattcccatattatgttatattatcagagagccatgtaaggggactatcttactttatatccccatagaatttccttcccagagttacaatttaacattttgtcctcagcttttttatagaggtcaatataagaaatagcacaggaagaatctcttctcccctctgccctttactctgggcagaattaatcctttacttgtctatgtatatactgtgatttatatatactgctatggtagcacttaggtaataatattattgtaaggaattttgctgtctgagataaatcttccctatattctcccctttgttttactccaaaggactataatcctgcagagtttttcactaatgaatttaggcattatttttctctaaaagaaagatcacactgaaaattatataaaataggctgttttcctgggatacccttgtggcttgttagaacacccggagtcagctggactggactgccactcttcttcacttactttataggcagatgctattccttttagagactgtctctgaaagtgaggaccctgggttatgtctgatcgttgggcggggagggggctttaaggttctaatttttgtatgtgtcctatttccatgtcttgtttcccagataaactatttccttctatgtctctgctttcctgaagacaaaggtacctttttctcagcagtggagttggagaggaaacagattcaggaagagtccaatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagacggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaatctattcataaaatttatacagtctttaaggtgcaaacaccttgaaggtagagaccatattatttctatgttctttatattggcactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggttcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttgagctggagaggtcttccagcacctgaaagacagagaaagaccctgtcttcaaagaaaagaaaagaaaagaaaacccatacatttagctcaattgactaaaagcctaaatgaaaaatatatatctttcagcttaaagggttggttggattgatttgttgagtaaggtattactatttggacaattgtaaaaaggacctgtgaaagccatattttggcttggacaagctcacccaccccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgatttaattttttaattgaatgggaataatatgggcatttttttatcatttgcccaaaatattttaagaaaatactatatagtgtaaccttttttttttttttttttactatgaaggcattaattttgttttatttttagtacttgcttccagttcacttttcaaagtgtcctttaggcttgttagtttcaaaggaaataatatatttccttttgacttaaaatgcctatgctatcattagatattaatagtagaagtaacagcaggattgcctggcacaaatttgtcctgtccttcttctggctaggcaatagggtgcaaatgttccttgctgtgcttttgatggtgaaatagaaataacgcttcacattttataacacattatatttcataaagctctttcacattcatcacttcatttaatcatcaaaaacaattctgcaaactgatattatttttcacatttaagtgtgagaatattgatgctcaaggaagcaatgatttggctgaggacccaaagtgagtgtcagtgccaagacttaaatctatttcttctcactcactccagagtccttcccacatcatcacactgtctccttctactgtgctttgctctaacctgctgaactaactagcaagtgtctttagcatactacattagatagctaagacttactgaatgcctactgtatgccaaatcctgtcttaagaacttacatgtgttacctaattcaatccttgcaacccatgtatgataggtaatattattatctccatctcgcaaataaggaaacatagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttatggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtcttccctgtcccaaagaattgatttttatagatatttatatctacttttgtgaacatgcaatgttcattttgattattattaaatcaatgtaaattctgaatgaatttctctgacttttactttgcttattaagttgaagactcaagggcaatgcagatgagaatttcagattcttcctttgagaggatttttggtcagtggctctttaagaagacccaaagcaggttgggtatacttcgtaaaatcagatacttggtatatagttcttttttttttcttttctttttttggtaacatcaccacgaggatttctttgctgaaatgcactgaccttctgtaaaaattaacactggaagtattttccaatggaaattgactaataaagaaatcaataatgaaggaatatttttagactggcaagaatcatgatgacactgttaagaagaaaacattgtacatatttaatatgtttaaattccagatcctcaatattatgattaagaatttaatgatttttgtttataattccttctcattgtgtgcccacatcatacttagcttaaattatgtatctaaatatgtcttctctataaagtttcttgtggtcagaatcaagtggtccactagtttcatttagcagtagatgtatatattttgacacataccaaagaagtgcagctcagtacccaaaagatgtactaactgaaaactttagttcatgtaatatgcccggcattcaccctcgcggaatttagacaggagggattgtggcctgtatgtttgacttctggaacttaccttagtaaaattcaaaaaacaggttcattagtaatttcttcaaagaaatctgcttcaatttattcagatgttttgtagtctctactttgtattaaatataaagcactgagttaaagaggtaaaaatatcaaaatgaacaggatagtctctctcctctgggatcttataatcatgtaaagaaacagatatgtaaaaactgtaaaaaagatatgtacaatataattataatataggaaaattaaaggccatacattttgtaaataaacagctatgggaacaaaaaaatgtgcatttttttttctaattggcaaagtctaaatgggattgtggaggagcagtttgtatttaagcctgcaattgaactacatgtattatttttaaaactggagatttgaagggaacactggtggcaaatagaattgtatgaacaaaggaacagagatttggaaaggcagatggatgtcagcatggctagaggacaggtacacagctgatggggcagaaggtagctatgaaaggtttgcagaagtcagattgtcagtttcttttaaagcctgctaaatgtgtacactttattgtgtaaacagtggcaaacagtaaaggttttgaactgtaatgatgtagtggtctgggctaaactattcagagcaagcattttaggttacagtaactgaactgtgggtttttgtttacatgtatccagagttgttccctacctttgcaaggtcagtgtctcagtgatgtgccttaaataccttgtccttgaaatagaacctcaacatcttcaccttgttctttttttttaaaagaccgtgtcttactctatctacaggcatgcaccaccatgcctggctaatattttatatatttttaaagatgggacctcactctcttgcccaggctgatcccaaactcctggcctcaagcaatcctcccacctcagccccccaaagtactgggattacaggcctgagccaccatgcacagacttatccctctcttaaaaaaatttgttttcaacaaattcatatgagtaagattaagaagaaatggtacaaccagacataagctgaaaagcaaaagtctcctttcctactttgtttattttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatttgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccctattatgaacatcttatattagtgtggtagatttgttacaataagtgagtaaatatgaatactaattattttttattgatatctgatattatttggctctgtgtccccactaacatctcaccttgaattgtaataatccccacatatcatgggagggacccagtgggagataatttaaccatgggggtgggtttttcccctgctattctagtgatagtgaataagtctcatgagatctgatggttttataaaggggagttcccctgcacatgctctcttgcctgccaccgtgtaagacatgactttgttccccctttgccttctgccatgattgtgaggcctccagagccatgtggaactgtgagtctattagacctctttcctttataaattacccagtcttaggtaagtctttaatggcagcatgagaaaggactaatacaatatcaatagatattgatatcaattatttttatcataatttattcagattttcttagttttcacctttgtcttccaggagcccatcctggataccacactacatttattcattatggctccttaggttccacttagctgcaatgttttctcagacttcctttgttttggacagccttgtcaactttgagtaatactagcagggatactgatgttttcctaagtaccagactggcgttctaggtttagtaaggaagttcacagaggtaaagtgctatgcatgatatcaagtatacatattatcaacatgactttataccattgatgttgaccttgatcactgggctgaggtagtgttgtcagattactccgcctgaacatcattgacttttcccctttccattctgtactgtttgggaggagctcattatacacagttcacacttaaggagtcaggaattactgtccacccactggagggtgaaatatctacataaattaattgaatttttttttcttgagatgaagtcttactctgtgggccatgctggagtgcagtagcacgatctcagctcactacaacctctgcctcccaggttcaagtgattctcctgcctcagtctcttgagtagctgggattacaagcacatgccaccacgcccagcaaatttttgtatttttagtagagacagggtgtcaccatattggcaaggctggtctctaactcctgacctcaagtgatcctcccacctcagcctcccaaagtgctgggattacaggcgtgagccaccatgcctggatggaattcttttgtatggcagatctatttcttctatcccatttatttatttattaattcatttatttacatcaatataggcttatggatattcattttatactttgggttaccatccaatatgacttcactttgttgcttaaattgttccagctttggccactgacttctgtgcccctctgacgtttcccatcagtgtgggatttttttttttaagcacttccttactttctggaacgacatgattctccaggcttatcttgcatattttctgcttcaacattaggcaaccagttcttcaaggagctatgactcttttaattggggaacagaacaaaagccaagacctgagtgctaagtgtgattgttactattggggtgcccttgcttctagagcttctcagctgataaagtaaagaaatttatgtgtgtatactaacttgtgcctgcgcacctatctataaatatttctatatgtaaacttctgtgtctacattaagctaaacatgagtacattttggtgtttccaagtctaatatattaccacctggttagtctagcctattccccttgtttttttctgtaaaatcctacaccaaagtgagaaacatggcttctaccttcctctatccattcacataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatatagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattccatccaacaacagcagtatacacattctgctcaacctcacctggaacattcatcaagtagaccatattctgggccataacatttatcttaacaaattcaaaagcgtggcaatcactttgaggaacttgtccagagggtataaggaaaggacaaacaaatgaaatatagaaatgatagaaaaagtgaaataaagagaagacattgtaatgttaatgtccataaaatagaaatacaagaagcattaaaaaataaataaatcaaggatagaaaatatttgaagaatattgtattcaaatatatcttataatttttgaaattataaaagcattaagaacccaaatttgagggtttcataaatggttaacaaaataaagaaaataatcctttacctagctacattattgcaaattttaggacataaaaggcaaagagaacaaaacaaaacattcaaggagggaaaaagaaacaagtattcaattgttatatttctcaccagttatggtggatacatgaagataatacgttactaaagaaaaagtgctttaaacctgggaatttatattttattaaaatataaaatattatttaaatgtgaaaatgaaacaaatttatttttagtttgaccacttaagatgtgctttgaaaataccattgaagatgggatatccataaaatggaatattattcagcaataaaaactcatgagttatcaagccacaagaaacatggaagaaccttaaatatacattcctaagtggcagaagccagtctgaaaaggctgtatgattgcagccccacgaccttctgggaaagggaagaccatggagacaataaaaaagatcagtggttgtcaaggattcagggactggttgaggatggagagggcagtggatggggagggaaatgggtagaacacagggcatattgagggcagtgaaactattttgtatgagactgttatggtggatacattgcatcatgcatttgtgaaaactcataaaagtgcacaacaccgagagtgaaatctaatgtaaactatgacctttaattagtaataatgtatcagtgttggttcagcacttgtcacaagtgcaccacactaatgcaagatgtgaataatagggaaaaactcgggagggtgggggctgggggaaggtgtagaaggaatacatgagaactctgtgcttttggttcaacttttctataaatctaatactgtttaaaaaattaaagtctgttgattaaaaaaaattacaccccagaaagaaaatatatccaggagaacccaggaaaatatgggaagtatggatgagaaaactatcaaagctatcagtaaggtatattacttataaataaacaagaaacaaaagagaaaaagcatacacaaaacaatccagactaacaattctcaaagacagaaatgtggtgtggtgggaaaaatgggatggagagtgtgaacaaagtcatgatgagacctcacagaggcaaaaatgtactaggatacttgtcttgggggcaatataaaatcatgtatataatttaagggtaattaatacaagtgttcatttaatacagtgggaataactaaggaaaaataggatttgagaatataattctcaaaccagaagaagaaaatttggtatgaccaatgaaaggaagaaaagaaaagaaggaaaaaaagaaaggaagaaaacatatagagaaggaatagaaagggaaagaggaagaaataaaggaaaaagggaagggaggaagaaagaagggagggaggatggaagagaggaaggaaggagggagggagagagggaaagccaaaacaggcgaggaatgatgagaaggatgggtagctgttctgtggattgtgtgagttaaggggaaggaagtggtgggacttaacatcagctccatatgctacagagtcaagtatcctcacatattcttacattttccctgaagttatatattgagagccagtggaagacatcgtagaaattccctggtctattttgtgaatgtgtcttgtagtacatagataattacatgtgagccattcctataaaaaggtttagattggtcaaggatgaaagaaaaagagacttgcaggtggaaaacaaaaagggcaataaattaaatctttcaaaataataattgctgaaaaatagtcatcttaagaacctcatataactactagtttaaaatattgccatccagttattgaaaaaagcaatttttcacatcaagaatttttatttatcttaaaatatttcagaggcaattggtgttatgctttagacacttgactgacagtaaaagtttactataataattcaaatgcctcttcaaagtggatgaacagaaacaaaacgttcagcgaggtgagtgttaaattattattatttagtgggaaaatgacctgaactattttctttggttgctgttacataatccataatctgatatcagttccattttgttgtttgtatttgtgcttgaactttcaatacaatagaggtcactaatggaagcctaaaaaagaatttttatttgacttttggttcattagaagtttctttgttctagttattttccttagcagagtgaatttctctcactttctcactatttgtccaatttactacctaagcctggatgtttgtcttttcatactctggaaacatggacaaagacaaaacatagggagtttcgaggcattattcaataactacctagagaataatggctctattttatatgatctaacttggtcacttgaatgggtcatatttctccaatattcacagaaccacctaagttgtttttggttgtgtggacatagatcagattgcctttgaatcatgatttgtagatgtaaacactatttattagttgtaaaaactttatattatctttaacagcctggccaaaaggtcattattgtttaggccttctgccttccagaaagagtatgactaaaacagatgtattgggcagaatttccagaaataccccaccacccccaatttcacagggctaatatccagaatctgtgaatgtgatgtcttttcattcccatgattgtcttatgtgatatgacgtagttgaccctgaaagggtagggtattcctggcagacctaatctaatcacagaagctgttcaaagcagagaaatttctcgtgctagtgacagaagacgaaagcatcagggaaagtcagaggaattcaaagtgtataaaggacttgagctgttgctggtttgaatacagaggagccacatgagaaggaaggtggttagccatgggttgctgagagagagattcacagctgagcatcagcaaaggaacctggagctcagacctagagccacaaagaactggattctgccaacaacctgaatgatcttgaaagtggtttcttcccccacattctccagattagagcccagtaagccatcaccttgactttgaccttgtgataacttgaccaaacctagctaagctggccaggacttctgacccacagaactgtgaaataatacatgggtgttgttttaagccattgagctctggtaatcagtaatatagaggcagacaataaatatagcatctaaaaccagtagctgtttattttgagatgtcaaagaggatcccattctggtgtttgatatttcagagtgccaggccatttttcctcacatcccactgacattcctcttgttttgatttaaatgaatagtctcccttagatgtcccagacaggattataagtctctttccttaaaagtttcagttgttaagatatgtagcataaaattgtatactataatggatcttgtaaatctaaccatttgctaaggtaacacaggttgtaggaagcaaatctggtactagaagccaagatgaaggattttcaacctagtgacctttctactcaaaagccatactggctctgaccttcatattttaattgatcaggcaaataatctcaaatcctccaactttgtttgattatttggctaattctgctcagaatcctctctaaatatctactggaggcagggacattaactgaatttgaaaagcaatattatggtaagactctctctaataataccataaaataccatagcaaggttgtttttaacagataattaaatgaagtccaaaggaaataactagcttgcccaaggttactctttgcaattgagaaaactgaggcttgaataggtgtaattattcattcaaatgtcctcggccagttcatggcagagatagaaagtcgatccacatctcttgatttccaattctttttttacactgagctatgtcaatatgtcaattctatagggtttgccctcagattagtttgagaaataaagtatattcacagcctctgtgttttcagtgtactaccagctgggatatctatgacttagttccaagctgtgatattctctgggactacaaatttttaagagccattttaaaattggctagaaggcaaatctagggtgcccataatgactgtacccagccctgctatgagtgactgcactgtgatttattccctactcagtgcccatcccccactccaaagccctacaggatttaggaaaaactgctggaagaaatgctacatcatgaaagcttaaaaaggctcagggaacaccacacttgaatcagtataggtgggactggtatatttcttttgctatttcattatccattttgcagttcttataaaaaatgagtctgttgatgtagtcttctgaagcattaagatatatgctatttctgcagtgaacaggctgcttagtgaagaagagtgtcggctcacttttgttctttcatatatttattagagtacgctttcccagagtgtcgattgcatgactttattgaagctagtttgaactcagactttcccccactgaatctgagatccactgaggcccagacaccaaggagctgttacacatgtataactattccattcacacctcttcaggagtttcaaacaagtttaattataagagaaacaaaagaaagcacttcttctttgccactgctaggaaaaaaaattgctttgcttggaaatcaattcattgtaagctttaatctgcctagttcggtttctcagaatgaatatttcaaatattaaatattttcttgagtagaatgtatagtacatattttatactaatatctatgtgtgtgttagacaattaagaagactggagtgttttccaaaaacttgaaaagttttcggtgactcgtaatacagaagtgacatttttatttgagaacaatttaccagattatgtcaagttcattattggtatgatactaattatccttaggataaattggaaaggggaaccctctgctagttttctgaagagctgcgtaagcctgatgaaatgtcttttctctttctgtgactcaaagctccagaaaaatctgcaaagttgaatatcacttgtgcctgctaatcttgtgtcatagttattttctatcactgtcataatgtcagagaagcactgggaaaatctgcacatcactcatctctccttcttcacccttatccaggtatatccacatatatccaaacatccagaaggtcacaggtgggatatttttgaagatgtactcacttcagcacaggtgaacctgttgatgacttccaggtctaaatatggtgaccttagtcacactggttatttttagggagcttcctctgactctcttataaactcaagatgataaatgcaatctacctgtaagattcttgagaaatttgtgttgtataatatgaccgtatatgatcccagtagttgtgtggaacttgataggaaccacagtaagtatcacctctccttgcttccatcattcccctactccaacagtttcatcttcctcttctgtttctagtgaataaaacatagtctgctgattttaaggtatattccattcccagttgtatacacaatggttaactttacattcgtgcaatcagtcagtcaacatttgagtgtgtactctatgtcagatgctgttttaggtgctaggggcccagcagtgaacaaaacaggccattgctgtgctggaagtaaaattctagttgggggagacataaaataaggaaataaataagtatataatataaggtaatatatacaaatgaaaaaaataaagcaggaaagagggtagggttttggggggaagaggatgttaaaaagttctaatggtctaggtatggctcattgacatagtgacctttgagcaaaatcgtgaaggtgaaggagctttactctttgaatcaggatgtcaggtcttagtttagactcttcagactagatcttagccattgtttatagatttgcttaaatgtctaattctttttcagctgattatgttggagtttattgttcctaatgaccaatatgctctaccaatgtcagaggcctgattgacttttgagggacaatgactgctccagtttatgcactttctctccccccagccctcccatccctcccatcctcctctgcctaccctccccaccccactcactttttggggttcctttgtcagctgtgtattatggcaaggatcgacattttcttgacattcattgtagagaaggtgatgtaatctctccttggagggtggtcacctgctgcttgcaggctgagctaaaagcagattctctcaatgacaggtatgactgcatttcctgggcaccttcagcaaacaaggctcttgcaacaatagcttgcgtcttattcttaattacttcataccccaaattaggtgggctaaatatctttttgttgtcacagaatggaaagcacatcataattagtgtaaaacaaatatcctcatagggtccaacatgcagtatcctaaaagaaaacgaagtaaacaatttatgtattttgtaatatacatggaatatgccattaggttgttttgcaaacccatgtaggtgatcctggtagattagatttacaatatatctttcctttcacttcattctctccatcctctatccattaatttttcttatatctagaaatagggcactaaagaaaactacagtatacagttcctgctttctctgaaatcaactattaacttcaggcaagtggaacacatacttggtacattacttttttttaaatccctgtattgcataatagaagagaatggtaatttttatcatgccattaatgtgattcctttctttattgcttaaagtgtcaatcagtcaaattgaaatgggttattactctgttatcttcttcattttaattatttggctctcccagcattacccttcattacctgttctccagaggatttgttttatctgaaaataatttactgcttaacatcgatgcatttttctgatatcgttaggtgggcctggtgttacatttagagagttaccgtcatcagagtaagaggaaatatatacagtgttttatcttgcagaacttaatgtaccaaatctgatgtcctataatgtttcagagggatgatacaaatcatttgcaactagaagctgaatattcagccttgtcacaagaattctcccttattcaattagattttttaggtgtttgctttaaaaagtaatatcagattagtaatggggaagcaatctttgaaatcattggtgggccaaaccatgataataagatacaaaagagaaatgaatggtgggaaatggcagacacattacacataaacattgttttgttatggcaaatctctacggcttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggctggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgtcacttttgcagctgacaattattgtttttggtcaaaaaattgtaccttgcaatcaaaatggcttgttatccaaattgatctctgatgctacaaaatgttgtttgtggacaattctcctgagcaccactctccctctcctccagagtttacagttgaaatggaagcaatagaaagtcaggagaacagggtggggctgaggcatgcctggtcttttcactgctaggcttggatgcctaggaaatttacctggaggcttctgagtaactgaacctctaaaagatattaaacgagactttttcactattttattcatagtttgtgcttacttttaagtgagcttttgttttggaattaaaccctgacagtcagtggcagctagaatcgccacctgtcaaaagtaaggtttccagtaaacaaaatatttacatatatcaagtgtgagagagactggggaaaaatttaatgggcaaacagaaattcatagaaggctacaaagtctttcttgaccagtctcacttgtaggtcttaagcctaagatgccatattacaggtggatcagcttcgggaggaaagcaagagctttctattggaagcaagcaaacccctctttgtgagtttctttgcatttgaggttctataaattttggagctaaaacagttagtcccttatttttgtttcactgaagctgctgaatgctaataggttattgatgatggttttatttgccagccatgaaaaatgcttggacaacaggacatgcatgacagttaatctttgtagagagaagatgagcatcagtggctgaattaggtgcggagggttgcagatgatatttaggaacacagtgacatcaagggagagggtagcccatggaactgctggccataaatagttttaggcatactaaaaatatcaggagaggataggagagactatgtggaattgctttacaagaatggcagcttcttaagaattataatgagatcagaaggtacaatgcttttcagtacttagaggtttttttctagatggaaataagcaaaagtagagaattaccagggtttacattttgtctccatcatttatagctaattgaacatgggagaaaacgtagcttccttctaaggctcagcttcctcaactggaaaattggactaaaaaagaaccatacttcagagttgttaacaggattaaatgagataatatatgtcaagtgcctagctcaatgtttggcacctcagcacatgctccagaagtggtatcaattattattacataacagagataatatttggtgggctatgtgtatttgtgagtgagagggagaaagataactgttttttttacgcatttttgtgaatgtataactttctcccaactcagctgaagcatccaccatggagagaagtgcttcaggactgttaccagagaaattgaatgagaaagagatgaaaccattttttaacatccctaatgggaattttcagtgaatggctagacagtaggcataaaagccaaactgtcatcagggaagagtctttatacaatcaattatcaagatgcctgatggataaactagaccacaagtcctgcaggaggacttgctgggatggataaagtaaggaggcagtaggtcatcccttctgttctgaggaatgtgagaggaggacaggaaggtaggaagggcaggagagtcttcctttgcagactgtatccaagactggaaagaaattttaaattagtaaaatgagataccagcagcaggaagaggaaccactttgctgaccaaccctatacccactgggtaaagggagacagagcatcaaagtgatcccagtgatgtcatgtagataggcacagagaaaatgttggtgcttagctttcttgagcatgcctgctaataactggcatggatgggactgaaaagttcctgggttgcctaaataaaatacaaaggtgataactgctaagctgtgccagtatgaaatgaaggcaggccaaggcctccacagagaaccaccagccctgattaaactataagagactggccaccagattccagcatcagatcccaggtagggcgccatacaggagagaacctacaccagggactggcatgatctcagactcccatagatttggaaaccctgtctgtccactaccctatcatctcaaaactcactacattctgtacactcagtgcaatctttgaggggaacagagaaaagagagaaaatgggaaatgatgggattaagctaaactgacatgatagactaatcctaatcctattccctccctattcacctctgtcatcaccagtgccacacagaaggtgggagtcatgagaaagacacaatgcattgtacataaaaggaaaaaagctgtgtcttcaccaactcaaaataggaaaaattgtgaccctgtgatgacaactattacagctgtcataataaaatcaagatgatggctgtatttctcaggcctcacatcaccttttcttttacaaattatttgaaatttaaagtagttttttctaattctgtgaagaaagtcaatggtagcttgatggggatagcattgaatctataaattactttgggcagtatggccattttcatgatattgactcttcctatctatgagcatgggatgtttttccatttgtttgtgtcctcttttatttccttgagcagtggtttgtagttctccttgaagaggttcttcacgtcccttgtaagttgtattcctaggtattttattctctttgaagcaattatgaatgggagctcactcatgatttggctctgtttgtctcttattggtatataggaatgcttgtgatttttgcacattgattttgtatcctgagactttgctgaagctgcttatcagcttaaggagattttggtctgagatgaaaaattcatcctgctaaaaatgcttgatctggtaagccaagtgctagagagactagaggagccaaggaacacgtaggtagggtgagataacagaagaatacccaagctgaattgaaaggaggaggtgcaaagaagcttgtgcattggattaggaaaaaatatagactttgaactcacaaggacttgatttttttccaatttgtcgtctcactctctgcataacctctattatgagttgaattttgagccccccaacccccccccaaaaaagatgttgaagtcttaaatcccaacacctgtgaatgtgaccttaattggaaataaggtctttgcagatgatcatcttaagatgaggtgattaggatatatcctaataccacatgaatgtatctgtgtataaaggggaaatctgaacacagagacagacaagtccaaagaggatgaaggcagtgatcaaggtgatccagctacaagccaaggaacaccaaagattgccagcaaatcaacagaagccaggagagaggcctgaacagattctccctcacagcatgcaaaaggaacgaaccctgccaacaccttgatttcagacttctgacctctagagctgcaggatgataaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggtgtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaaattctacaggcagtgctgaattgctcagtaaacaatgcacttaatgatatttccttggcaaatttggtgaattatccatacactggtgtgtatgtataacatggtagtgcaacccccaacctgaaggtgacacttgtgcgcacgtaaatctctatttcttagagatgtcaaatcaaatcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttgtttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctctatattttttggaaaaacaaatccaaaatatgaaacattcagataggtaggcataacattcagatgtccagtgatggaggtcttgctttgaggggcaggctgtttcaggtataaataaatctctcaaagtctatttaggaaaaagatatatatatattcctgcaacttcttttgtttatttttattttttgtagagatggggtcttgctatgttgcccaggctgttctcgaattcctcacctcaagcaaccctcctgcctcagtctgccaaagtgctgggattacaggtctgtgccactgtgactggcctctgtaacttcttaattctgtctgcaggagccacatggaataatttatttagtgctttaaatatatatatatgtcactaagccattttaaggaagataatcagaaaataattatcaagctgttttgaccaatataattcagattctacttcaaaaaattacaagagattgcctgaattattttttatattaaaaacatagcaggcatatgttacacaatgagttttgttctgtctttcatttgttaatactttcttaggatgataatagaaaaaaaatttgagaatttatctttctctgtaccatcaaatctacagttttccgttgtttattctcagtcatttccattcccaatttaaatgttggatataataaccagccatattaaaggcccgattctatgaatagaaaacatgaaaaaaaatttaagcgaggatttgggagatggtggtaggtaactgaacttggtaataacaataaaatgatcccaatcagaggctgttgtgtgagcacagcctgtacaattaatagtgacacttcagcagcaaagccactccaagaatcataccatcgtttgccattttatatttctctccaagattttccagagaaatgccatcaaaagcacaaatactatttctaggattccaaactctaagaaacatattaattcagaagatgttaaagcatcaaaacagagaggaaaatgttggaatggttactatttatgactagcttctgctctctgcactgaagagcgtagctatttccttcattttacagttgacattcagaaaaagtacattaaaagtacccagaaaagccttatctctgcatatttttgcaatttggaaggacaaatagaaacaacattagaacttgatacatttagtcgtactctgtattgtagacttggagtggaaaaactgtattgtagactcggagtggaaaaaacacaaactgttttccctccgctctcacaccacaacaatcaacacagatgacttctgtgaccaaatgtgtagcagcttctccacaccaacaagcaataggcaatcaatcagttctgcagcagacaccagctgggtgtcatccagtttaattccaacacagcctggatggagatatcatcagatcccacagcttaaaggctcagtcccacaagaccaccgttcgcttcacatggcagtcacaggccctgggttgttttacatgcgcttctgaccaattgtctataaatcagggttcccatgaccccttccttgtgttcaatgaatttgctagagtagctaagagaactcagaaaaagacgtgactcagtttgttgtaaaggatattacagagtacagatgaaaagatacgtaaggaaagacatggggcaaaggatgtggagcttccctcctgggcacaccaccctccaggaacctccacacatttggctctccagcagttgtctgaacctagtcttttttgtgtttacagaggcttcattacgaaagcatgactgacaaaaccattggctattggtgagcaacttaactttcagcctgtctcccatccctggaggttgggggtgggactgaaaatcccaaccttctaattctgccttggtcatcttttggtgaccagtctccatcctaaagctacctaggggttgccagtcctcagtcaaatcattagaatatgaaaatatatcattttggaaaccctaagaattttaggattgtgtgccaggaaatgatgtcaaagaccagatacatgttttataatatcacagacacatgcataggttgtccaattttttctaagtgaagttaaaaagtatttcaaccccaattgtcctattcttcccttacatcattccttcctatacttctgtctaatgtaattaagaagaacatcgaggggaaacaacttttacttgatcagagaattaactgaactattcacttcccaagtgttcaactgaaaggtagattattttatctcatcattttaggattccttttcttaactgatttgttgtttatattgagtaaagtacaccaatattaagtagtacatcttgaaaatgttttacatatttaaaggtaatagctattgtattttctattaccctatattaattttgtctgtttatgagccaaaaatagattgttgcagaaaatatgtactctttgtatcttatttctttctctgagtaaaatgctttttattttcatctattttctttcacacagcagtactttatcttcttttatattccactaaatgtatgaaatgtatgttgttttttcactgtcatgttgatggagatatgggatgattccagccaagggctgttacaaataaagttgatataagcattcttgtatatgtcttttggtgggcatgcatactgatagaagtggaattgctataggtagatgtatatttagctttaattgatactgccagactcttgcaaaatagttgaactggtttatattctcactgacaatgtatgagagttccaggtgctccacatttaatattgtcagtatttttaattttagccattctagtggatgtaagttggtatcatattgtggtttttaatttgcatattcttgatgactaatgatgtttgggacattttcataggcctcaactgtttgaatatctttttagtgaagatgttctttcgattttttgccctttgaaaaattggtttgttcatctttcttattgatttggaggagttctgtttttttttgagacggagtctcactctataacccaggctggagtgcagtggtgcaatcttggctcactgcaagctccgtctcccaggttcacaccattctcctgcctcagcctcccgagtagctgggactacaggtgcctgccaccaggcccggctaattttttgtatttttagtacagacgggttttcaccatgttagccaggatggtctcaatctcctgacatcatgatctgctcgccttggcctcccaaacagcagggattacaggcatgagccagcgtgcctggcatggaggaattctttttatattctgcttacaggtactttgtaatgtatgtgtacaggtactgtgtaatatgtttttccactctatggcttgcctattcactttattaataatgtcttttgatgtacaaaatttctttatttggatagagcccaatttataatttccttttttgtgtttagttctttgtgtttgtttgttgaaactttgcttacctgccaaatcacaaagatatttttctactcttctagatggttggtgttttagttctgtgtttagatctgtatccacctggtatttacttttaattatgatatgcaacagggaccaaggtttttatttccacacagttgctatagtaccagataaccagtgctatagtaccatttattgaaaagactatccttttctcccattgatttgcagtggtgactatatcataaaccatatacctgtgggtctccaggtctatttctgtagtttattatgctcgtttggtctattctgttatctttactcattatcaaactcctccagcttcttgtacatgtttaagattgtctttgttattgtacattatttccatttttaaataaatttggaatcagattgacaacctcctccccatgcctaccccccaaaataaatcttctggggttttgaatgctattgcattaaaaccgtggatgagtttaagtttgttggaaattgacatcttaacaatatatcaagttctgcagcctattaacatggaataacatctgcatttagttagttcatttctttcactaatgtgttctattttggaatagatgtattatgcatgtttcattagatttattcctaagtatttgtttttgatgctatgctaaatggtatttttatctcactataattgttattattatatgaaattcatggatatgaaatacaattaatttttgtatgttggcctagccagcaaccttactaatttcccttattagtcattgtttctttagtattgtttatgaccatgttatgtgtaaataatgatagttttattttttcttgccaatttttgtacattttatttcctttccttgctttattgcaatgcttcattccagtataatgtggaatgggtgataatagacatccttgtcttgtccccaccatcagaaatgcactcagtctatggtatcatgttattaattctctagtgaaaccatagtttgtatttagtaaaacaacaatgtacatttggctatttcaagcttaattgaatttctttggcctctacatgattcttccttgctgaaaaggataatttataacaaatatttcattacttataaagcaaacacttgcatttcagaatacctttgtatttcactttcaactctagaaaatatttgttaggaaagtataatttatgaactgttataatgctttagtttctattcatttatttgggatttaccatgtattgctttaaattttaagcaatttttatatgaattgcttctactctacactatgaacacaaattcaaagatagcctgtatttgtattaaatttctttgaatctcttaaggcaactagcataatgccttgtctcaataaatatatgtttattgctttagagaaaacaagtccattactattttcaaagttgaaattgcgttatatgtttaagctgccatttaaacagcactacattttgccataattttgctatagttaacattccaagtatattcaaagttgatttttatttttttcagaaaaaatgccttagtctgtttggtattgctacaaaagaacacctgagactgagtaatttgtaagaaaagaagtttgtttagctcacagttctgcaggctgagaagttcaacggcatgaccctggcttctggcaggggcttttattctgcatcataacatgacagagaaggtcaaagaggatgcagacatgtgtgaagaggggaaagtttgctaggcatcttagccctgtaacaacccactctggtggaaactacccatttcctcaagaactaatttagtttagtcttgcgagagtgagaacttactaccagaagaacaacaccaagccattcatgaaggatctgccctcataacccaaacacctcccaataggccctacctccacactggggatcaaatttcaatatgagttttgatgagaacaaaccaaccatattcaaagcattgcaaaaagttgaaaaagctctactaatgtgtaaccagacatgtgaacatatataactttgagacatagcacaacacttaaaagccttcagaatcataaaaaatgtatctatcaatcttaatattttattaactcaaattatttttacctggctgcatggacatacaacatttaccctaaatttaaaatagaatgcaaattaatattcattggtattattttcattaattgcacaacatagtgaaaataatgttaacatttttttcctttccttcttccttcttctcttttgctttttttcttacctgtaaattaactgagttgccagatatccatagttatcaatggcaatttggaggctctcagaggcagaagtggttggtgtttttctatttattgttctagatttgggtctgagcacttttataagtgaaactttccaggtattttgttgttgttgttgttgttatatcaggtcttaaactatacctttataaattcttagtcatatatactaaagggcatttaatctcacgactgttatttatgggctttaagtcctctatgcaaagggtaaaattgtccctgtgaatttcagaggtagacattaggtaaagagagagttttttgcttgacttattgcttaagtcagagcgttctctgaatcttctaactcttcatttaattcacttgaaagtatttattaatcaatgtgcctaatacatagatgggactgcttccagtgagtctgtcagtcatgttaccagagcctttatttcttcctctatgccaagcttaaaaaatcagatgatttattttacatgagccacacatgcaaatagacctgtaatgctgaaattttgatacttaaaggtaaatctagtatcagagagctctattaagtggtctagagtatattcaaattacaagacatgcaacttattctaaaatctaatgcaatctactaacagcaagggagagggaactattcagagtaaataggacattgtttatctgaaattttattgacacattaattgacaactccattttatatgacgtatacaatcaactggacctgtttaatgttagtccttagataaaaaataattgtagctcaagacctcataattgtatatatttttttcactgtacctggtacaatcatttcatgtatgaaatgaatgagtccacaatacctcaatatttgaacattttgttttaattcacttaatcattgaaccacagagtctgtgctaaatgctattatctctataactcaacaataaggagatttaacagactcaccatttaatgtgcacgggagcacagatttcaaaatttgtttcagcacaaccttttggattatcatatatttgtaccataaaataaatcatctgattttttactctactgagacggatgcatatgcaacatatttatgtgcatatattcagtgttggaaattaattcataatcatgtatatcaagtgatttggatatttacctgcaccccatctcagggaatcattagagcttgcatttggaacatttaactgattttagttatgtaatgtaattttacacacattaccttacatttcccttcaaattccttctgaatcacactgttctgatttcctggaaacgcagttcaagaaatggccaagagtagaaggatgttataagacattgagtttcgaagttttcctttaaaatacaaaaagtgaaaattccacaaaagtggaatgaaacttgatttatagtgccgcaaagaaaaatcctggaatgtgcaggaaaggaagtgaatgaacttgggaacagctgcaagtaagtatgatgaacgactctgcattgggctagcagttcatctgttccacttgcagctgcaggccaaagcgtcaccaggttttctgcagaaactcaacttggcattttaatggctgaggtgaacccactggtggccagctgctgggactgaaaatcagaagcagctccagtccttccagattgtgaggggaaaggttaaggagagggaagtggtgccttgtcccagacagacgcccattggtcctgagatttcaaaaacaccaggagagagaatgcctggcagtggagaaaccaacactcagccttctctggaagaaagaaaaggcttgaggcaggattctcaagcttcatttaattacgatcaaatagggactggcagaagagcgtagctgcagatttgcagtaactctccctaaaagaacatgagctgtgagagagtgaccttgcagccagcactgatttgacattcacctgtttccctgcttgcattggaataccgctgggttagtttggatcccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggagccagaaagctggaatcaaaaattcagaaacatgaaatcaagaaagaactgaaaatctgaatggaaagccagtcacaaaagaataagaagtaaaatattctttaattatgtattatctcctacagatcaaaaggaactttccaccatttcattgaacctgtgagtgaaaatgatcccaaaagtatagagaaaataaagaacagtaagcaaattaattcagtttatatactgtcttttaacctgtttagaaagaatttgagaattgtttgatcctgattatataaaaaagatatatctgtatctatgtctacgtatatattaatacatacaaataaaatttctagaaggaagagtacacaattaacagtggttacttctgaagaatgggaatgggatgttggaggagacagatctgtcacttttcattttatatttctctggtgagatcaagggagcatcttactttgtaaatattaaaaatgctgaaatatgtaggttaaaatgtaattaatctacattcctatttttcagaattaatctgacttaccatctggtcatttttgcttgcttacattttttcttttgcaaaactcattatgttgttttgctaaaaacaattaaaacaatgcatcaaactagtaagaaaaaaaaagtctcaaaccacagagaaagactcacaattaccattagatacataaaattctatgatatatttctttgtacatttctggatcaaataatggcaagatggatgaactgatggatagatggatatatagacatgcatcgatgtaggcagacagtaagatcatagtataattgatattttaatttaacagaaggttaaaactgaaattttgcttttagaggaactattgacctcaaataaatgttttattttcaccttaagacgtatctttttctaaaagatccaaagttaacttgaaaaacatggaagtcgatttttttttttttttttattttaacctatcaagctcaattgactccctctcataaaagtggaggcacagtggctcacgcctgtaatccccgcactctgggaggccgaggcgggcggatcacgaggtcaggagatcgagaccatcctggctaacaaggtgaaatcccgtctctagtaaaaaatacaaaaaattagccgggcctggtggcgggcgcctgtagtcccagctactcggggctgaggcaggagaatggcgtgaacccgggaggcggagcttgcagtgagccgagatcccgccgctgcattacggcctggccgagagagcgagactccgtctaaaaaaaaaaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatgggtctttttctatgaattattttcctacttgacaatatttacttgttacttttttactttcatcatgccttgggcgcatataatactctcccttcacattttctttccttgaatttgtggagaattttccattttattcttgcagtcaactttactgaaaacaaatctgaaataaaattaatgttattctaccgtataggcgattggctttttagtcccaagatgcctaaaaataagttacccttaacacataatagcttaacttagttaggtctagaaattgagggtttgttttgtaccacattttctagaaagagtgctccttcaacctaaagatttacttagctttttttcaggaaatttcttggattagatcttagaataaatatttattttcatttgttaaattctctacttcaggaatatctgttaacattgtgttggatttttttgtttaaagtattcacttttctctaattgcttttatctccttatctgttcatcttccttcactataattatcttaatccccatttctctgtatcagtaacttaattttcaattgcatccattgtttttctaatttatgtattagtttcataaggctattgttttgagttctttcccccttatatcggtactctcctttatcatctaattctgttattctattattttgtctttgaattttgttttagtgaacttacattcctctattatattacattatattagaattagtagttttgagtaggttggttcatgagtttgtgagtagggtagtttcaagtagggttgagtagtatttttatgtttcttgtgataattttgccaaacaatgaatatttctttttagtataaagatgtctcatggaatatttaggacatgtatatgctaaaatttatttgttgcttatatgaatttcaaattgagctgggtgtctctatttttatattttaatttgctaaatctgtatgttttttataaatttccttccttccctccttccttccttccttccttccttccttccttccttccttccttccttccttccctccctccctccctccctaatctaggaggattttatagttgccatagcgttttcttttctttttgctcatgcttgtgtgtccctaagatgccaagttaggtgggatatattgtaggtggcctcttgactctcttctcaccatactgtttgttttctttacttaatatacagtctgagaactgaatttactttcatggattatctgtttgtctgtaatctatgggaatactgggtgatgaaggcagggatctagtcttagatactctgcagccttttctctgtctcctaagatattttttctgtgcaatgggagaggggtttttgtccaatcccctgggaaatactataaatgaataatttctcaaatttgctgtgtattcttgaatcttcactctcttcaaagagacttaagccactatttcattccgggtaggagcagctaaactaaactaacagaaaagctacaaattacagtggcttaaaaaacaaaggacatttttcttgcttgggtaaagtttcatttatttttccctctatttcattgccatgacttttagggagcagtgacttctaaattgtggttcttaatcaactagagtttatagtttgtctaacattttaaaaatataatcagtttctttactactatttttatattactaattcattaattttcacccaaatctttaagaacatggctctcatggttagggaaagaaaattgcgcaaaggacttgtgtccataccgtttttttggcctcactattcctgaatgtggtttctttcttctaatgaccaaactttaggggactaggactgtgcatctcagaattaaactggtatttctgatatgtatggtttatggttcaatggaaaaatataagaatttttcaaataattttctgattgtaaggatgaatgtgacctaatgttaaaatggcaggacagaaatattaaagaactgaatgatggcatcagctcagccatttagtatttgattttggacttagtttcctcatctgtataataagagctttgcctatgtatttttccaagaccatttcagggttttgcattattttatttcatttggaattaacattcaggtcatcttatagtagtgtactgaataactgaatgttaaatgtcttgctaaaataaatattgggttggtgaagttgaagttttggaataatagctaaaattaataactatagattttaattaatgatttcattcactaactttcaaaagttagacattcaaaaactgcaagaagaatattttttcaagattataaattgctagattcttcctgcagtggaaaggggaacatgagatatttgcagtattaaatagatactcactttcaattgatacatttaataacatcactaaccttcctattcatagtgaaatgagtgatgaaaaagttttttagtaaatattttttactggaacagaaataattttgtagcaggattcataatttgtgtatactgatttaagaatatcattacttcctgaaagtggcattcatctctatgggtagtcattttaacaaggtttttgttaaaaccttccccttcattaacacactttaggaaagtgtcttctaagtcattctatcaaagtctgttgctttcaaatttgattaaagaaaacaaagtattatttgcgtacctcatttttctctaacacatttttctttgcatttctcatattctggattatgtggggatcaaatatgatttaaatgttatgcacaattttgtggtttttcctactaatgaaattttgagttgcaaagttaacattctgccattgttaatatattcttattataaaaagacaaaatttcaacacatttcatttaaagatctcaattggcttttacttgcaattccagaatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaagtactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaataataaatatatgtctatactatgactcattgatacatttcaaaatacagtgcacataagaagatcttcattctctagatctgtcatactacatatgtgaaagttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagagactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatgctgagagcttccctccttttaaaaaacaaaattctagtcagggaattatttttaaataaaatgcaagcccccaagacataaataaacagccagcatataatactaacaactcaatgaaagatacttccccaggtcaactcatctggtaggatcagttattttgtgttactgcattgcccctctagcgggatcatagaagaccctaaaggctacaagaagaactgctttctggctctcaagtcatttcagtggttccctgatggcagctgtctctttggggaggtggtgccgtggtctgtttggggttaggccatcagcacaggccccttgtgctagcatcacattgtcataagctttctgctaccatggctaccatccatcaccaggctctgtctccatgggcagcagcctctgtgcccaggccaccccaggacctcaggcccatctctctttccaaaggtaggtaggtggccttttcccattctttagtttttgactttgtataactgaagcttctcctgggatgatgcaggcagctgctgcacagtcactccagacttactcttcactttgttgttaggcccctgcagctcgctgcacgtgactggtgccatctgccctccccgcacgggcagctgcccctcccacactgcctatttccccctttctgctttttgtagccacatgtctaaagatggcaggccagtctctgtggtctattttatgggactttcatttataactaggcagcaacccacattagttatttatcctgatgatctccctcctcttgccccccatgacaggccccagtgtgtgttgttcccctccctgtgtccatgtgttcttattgttcagctcctacttataagtgagaacgtgtggtatttggttttctgttcctgcattagtttgctgaggataatggcttccagctccatccatgtccctgcaaaggacatgatctcattccttttaatggctgcatagtattccatggtgtatatgtagcacattttctttatccagcctatcattgatgggcatttgggtggattccatgtctttgctatcgtgactagtgctgcagtgaacatacacgtgcatgtatctttgtaataaaatgatttatatcttggggggtagatacccagtaatgggattgctgggtcaaatgatatttctggttttagatatcacaacaccatcttccacaatgattgaactggtttacattcccaccaacattgtaaaagcattcctatttctccccaacttgccagcacctgtcatttcttgactttttaataatctccattctaattggcatgagatagtatctcattgtggttttgatttgcatttctctagtgatcagtgaggttgaacttttttcatatgtttgttagctgcatgaatgtcttcttttttttttcttttattttcttttttttgagacaaagtctcacagtgtcgttcaggctggagtggtgcagtggcaccatcttagctcaccgcaatctccaccttccagcttcaagcaattctcctgcctcagcctccgaagtagctgggattataggcacctgccactatgcccagatacttttttcgtatttttagtagagatggggtttcaccatattagctaggctgatctcaagctcctgacctcaggtgatccacctgcctcagcctcccaaagtgctggggttacaggcatgagctgcctcactcagccatgaatatcttcttttgagaagtgtctgttcatgtcctttgcccacaattgtattgttagtttttttcttgtgaatgtgtttaagttccttgtagattctgggtgttagacctttgtcagatggatagattgaaaaaattttctcccactgtgtaggttacctgttcactctaatgaaaatttcttttgctgtgcagaagctctttagtttaattagatctcatttttaaatttctgcttttgttgcaactgctgttggcaattttgtcatgaaatctttgtgcccatgtcctaaatggtattgcctagattttctagggtttttatagttttggggtttacatgtaagtctttattccatcttgagttaatttttgtgtaaggtgtaaggaaggggtacagtttcaattttctgcatatggctagccagttcttccagcaccatttattaagtagggtatcctttccccattgcttgtttttgtcaggtttgtcaaagatcagatggttgtggatgtgcagtctattttttttttttttttttttggagacagagtctcgctcttctgcccaggctggagtgcagtggcaggatcttggctcactgcaagctccacctcccgggtttacaccattctcctgcctcagcctcccgagtagatgggactacaggcacccaccaccatgcctggagatgtgcagtcttatttctgagttctctattctgttccattggtctatgtgtctgtttttgtactagtaccatgctgttttggttacagtagctttgtaatatagtttgaagttgtatagcatgatgcctccaggtttgctctttttgcttaggatagtcttggctgtatgagctcttttgtagttttatataaattttaaagtagtttcttctaattctatgaagaatgtcaattgtattttaatggaaatagtattgaatctataaattactttgggtgttatggctattttcacagtattgattcttcctatccatgattatggaatgtttttccatttgtttgtgtcctctcttttttccttgaacattggtttgtagttgtccttgaagaggtccttcacttcccttgttagctgtattcctagatattttattatctttatagcaattgtgaataggagttcatattcattatttggctctctgcttgttattgttggtgtatagaatgcttgtgacttttgcacattgattttgtgtcctgagactttgctgaagttgcctatcagcttaagaagcttttgagctgagacaatggagttttccagatatagggtcatgtcatctacagacaaagacaatttgacttcctttcttcctatttgaatatcacttatttctttctctttgcctgattgctctggccataactttgaatactatgttgaataggagtgttgagagatggcttccttgtcttgtgttggttttcaaggggaatgattccagcttttgcctattcagtatgatattggctgtaggtttgttataaatggctcttattattttgaggtatgttccttcaaaacctagtttattgagagtttttaacatgaagggatgttgaattttattgaaggccttttctgcttctattgaaataatcatgtggtttttgtcattggttctgtttatgtgatgaattatgtttattgatttgcatatgttgaacaagccttgcataccaacaattaagccaactttatcatggtggataagctttttgatgtactgctggattcagtttgccagtattttattgaaaatttttgcatcaatgttcatcagggttattggcctgaagttttctttttttgctgttatctcttccgggtttggtatcaggatgatgctgccctcatgaaatgagttagggaggagtccctctttcaattgtttggaatagtttcagaagaaagtgtatcagtttctctttgtacctctgatagaattcagctgtagaccagtctattcctgggcattatttggttggtaggctatttattactgcctcaatttcagagcttgttattggtctactcaagaattcaacttcttactggttcagtcttgggagggtgtatgtatccaggaatttatgcatttcttctagattttctagtttatttgcatagaggtgttaatagtatcctctgatggttgtttgtatttctgtggggtcagtggtgatatccctttatcatttttcattgtgtctatttgattttctctcttttcttctttattagtctagctagtggtctatttttaattttttttttcaaaaaaacagctcctggattcattgactatttttaaaggttttttgtgtctttattgccttcagttctgctctgagcttggttatttcttgtcttctgctagctttgtggtttgtttactcttggttctctagatcctttagttgtggtgttaggatgtcaatttgagatttttctagcttttcaatgtgggcatttagtggtatacatttccctcttaacactgctttagctgtgtcccagatattctgatatgttgtctgtttgttctcactcatttcaaagaacttcttgatttctgccttaatttcattatctacccaggtgtcattcaggagcaggttgttcaatttcgatgtagttgtgtggttttgagtgagtttcttgagttctgatttgattgtgctgtggtctaagagactgtttgttgttatttcagttcttttgcatttgctgaggagtgatttactttcaattatttgatcatttttagagtaagtgacatgtggcaccgagaagaatgtatattctgttgttttggggtggagagttctatcgatatctatcaagtccacttgatccagagctgagttcaagttctgattatctttgttaattttctgtcttgatgatctgcctaatattgacagtggggtgttaaagtatccccacaattattgtgtgggagtctaagtctctttgtatgtctcaacttgctatatgaatcagggtgctcctgtattgggtgcataaatatttaggatagttaacttttcttgttgtccccttcaccattatgtaatgcctgcccttatttgtcttttttgatctttgttggtttaaagtctgttttgtcagaaactaggatttcaacccctgcttttttctgttttccacttgcttggtaaattttcctccatccctttattttgggtctctgtgcagctttacatgtgagatgggtctctttaatacagcacactgatgaatcttgactctttatccagctttccattcttttagttggggcatttagcccatttacatttaagggtaatattgttatgtgtgaatttgatcctgtcattatgatgctagctggttatttgcagacttttttgatgaagttgcttcatagtgtcattagtctgtgtactccactgtgtttttatagtggctggtaacaggttttcacttccatatttagtgcttccttcaggaactcttgcaaggcaggcctggtggtgacaaactccctcagcatttgcttatctgaaaaggattttatttctcctttacttatgaagcttagtttgaccagatatgacattgtaggttggaaattcttttcttcaagaatgttgactattgccccaatctcttctggctttttgggtttctgctgagaggtctgctgttagtctgatgggcttttcttcataagtgacctggcctttttctctggctacctttgacgtatttttcttcattttgacattgaagaatctaatgactatgtgtcttggggttgttcttctcatggagtatcttactggggttctctggatttcctgagtttaaatgttgccctttcttgctaggttggggaagttctcctgggtgataccctaaagtatattttccaacttgattctgttcttcctgtttctttcaggtaccccagtcagcggtaggttcagtcttttaacataatcccatagttcacagaggttttgttcattccttttcattcttttttctctaatcttggctgcctgctttatttcggcaagatagtcttcaagctctgatatcctttttttccacttggtctattcagttattgatactcgtggttgcattgtgaagttctcatgttatgttttttcagctccatcaggtcatttctgtcctctctgagctggtgattttggttaacagctcctgtaatattttatcatggttcttagcttctttgcaatggattaggacatacttctttagctcagtgaagtttgttattacccatcttctgaagcctacttctgtcaattcatccatctcagcctcagctcagttcagggcccttactggagatatgttatgatcatttgaaggagaagaggcactctggctttttgagttttcaatgtttttgcattgattctttctcatctgcatgggtttatttacctttgatctttgaggctgctgacctttggatgaggtttttatgggttctttttaattgatattgttgtcctggctttctgtttgtttttcttttagcagtcaggaccttcttacatagggctgcagccatttgctgggggtccacttcagaccctattcacctggggtcctcccacacctggaggaatcaccagtggaggctgcacaacagcaaagatggcagagtgctccttttccccaagaggagcaccaacctgatgctggccagagtgctcctgtatgaggtgtatggagacccctgttgggaagtctcaccgactcaggaggaacaggatcagggacccgcttaaataaacagcctggcttcctcttggcggagagggtgtcctgcactcaggagaatccgcctcatcagggctgccctgactctccagagctggcaggcagaaaagagtaagattgttgattcacgataccgcagccgcccctcctcctatgggctcctttcagggagatcagagttctgttcataaacccctggctagggatgctgaaaatcccacagggaggccccacgcaggtaggaggaatgggtcaaggttctgcttaaagaagcagtctggccaggaactgtccacagctgctgtgctgcgctgtggggaattgctcccgttccaaactgcccagtctcgctggcacctgcagcagggaaaaacggctgactggagcagcagtggtggtagccaccccttcccccaccgaactcggtcttcttaggctgtctccaacctgctacactggctgacagggattccaaagtgggtttcagtttgtagggttccaagggagcagggccgctgagcaaggccgcttggctccctagcttcagcccccttcccacaggagtggacggatctcctgcctccttagttttcccagagctagagtatgcaaaaactcttatgtctcagtgtctgcccaagtggtcgcccacctgagcagccgctgtgagcctgcacagctctgtgttttggacccaaggcccttggtggtgtgggctcacaagggcgtgggttgcagagatccatgggaaaagcgtgcttttcagagctgggtagcacaatacctcaccagcttcctcggctcagagagggagcaccttttgccgcacgcaggctccgggtgggccctcgctccaccctgcttttcctcactgtctgtgggttgcgccaaccatctagtcagtcccaattagagaacctgggtacctcaattgaagatgcagaatttacttgctctttttgttcttggtggaagctgcagactggagctgtttctatttggccatcttggctcaaggttcagtttgagtttctgttgcagacactgcaagaaacagaaccgaatgaacaagagatatgaaagtatgtatcatggcaataactgtttctgtttatttcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaaaaaggaaaaaaaaatcacatctaaaaatgttcaatgtcattacattgaacactgaccggacaagtaagctggaactgtatggttatattcacaaattctgggatgtttgttttggctttgtgttataattgcagctacgaaactaaaagtgaacaaattgctttctcatttaatttctttttatcatgtctaagtctcagtatttttatttgtagaattgtgttaataataatccacaggcttactatgaggaataaatcagatactgtacataaaacaaataggatatttgttgacatatagtattcattcaccagatgcttaatctttccttcctcttgtctatgttagcctgcgattgttattctagtgttggtctcaaataacttaaactgtcattagaattttgctttaattcatagggccaatagaggaggaggcaatggaaaaatcactaggtatgtttgcttagtctctcagatgctatagcacacaactctcagagacttggaaaaatggaaacacagagatgttgttttgtgttttgtttttgagcacagttcttatagtaaatgtgaatgtttactattatttctagggtttatgataaaagatggaaaagagaggctatactgatgaacgttgtcaacatgggggcttgtcagaaattaaacaaacttttaagaaagtaattgaatttaacaaacattattgagtaccttatctggcccaggcatggatcttaacctcaactcctcatcaagggtagaaagtagactcagtcaatgctaggcatggtggttcatgcctgttattccagtgcttttggaagccaaggcaggacgatcgcttgagaccaggagttcgagaccagcctgggccataaaccaagaccttatcgctacaaaatagaaaaaaaaaaaattagccggaaatggtggtgtgtgaatgtagtccaagctacttggggctgaggtgggaggattgcttgaaccgaagagtttgagcctgcagtgagccattatcacaccactgcactccagcctaggtgacagagccagatcctgtctcaaaaccagaaaacaacaaaacaaacagacaaaaaacagactctttctagtcatgactttattccagtgcttaccacctggtccttgccctcagagttcacaataaagggattctggtctgggaagaaagcaactttaaagaatttctatcatcattctcataataccaataaactccaaaaaagagcctaaagattttcaaatgaccttccttagaagttctagatcctagttgattacctgagcaaccatttgcctatgtgtatttcaatttaaattgtcataaacagctactcaaggaattgattaatctgaattcaaaaataacttttatttagtgaaagtcaaagcacattattgtgttttaaaaagtcaaatgttgccaactcatgacttagttaagcctggaatatgaatgtgcaattgaagcagacattggctgtatgcacaatgcctgctgtttttcttgctgttagtcattatatgttatgtcctttgtcaggttggaaacaaaagattaatttcatttggtaggcttttaaaaatgtgtttgtctggttgtgtgtgtgtgtgtatatgtatatatgcatatatacacatatatacacgtatgtatgtatatatatgtatgtatatatgtatatatgtatatacacacacacatatataaatttagttctgaaatttaggcatatatatatatatatatatatatatgaaatttaggcgcatatatatatatatatatgcgcctaaatttcagcactaaatattaaagtttaggcttaaagtaccaagatatttttttcagagatggattattttagcactaaaattcttctgagccttcagtattgctgagctttatttaggaaatactcagtgatagaagatgaatgcaaaaaaaattgattaaaaaccggagccttaaaaattgaattcccttcttactgttgatgttcttatattattttggtatctacataaatgattatttgaaaaaatttctgacatctgatgatgtgtaacatgccaaattaatttccgaatgttaaaaatcattttacttatggataacttcattatgtagaagctgactatctaatttgtaattatttttatagaaaaatggcaagtagaagcttatcatgggtgaagttaacaacaaaaggctaaaatttatttgtctctcttcagtctttttctcttcagtcaaagacaacttacacacaacaagatttctccttcttaattactacatttattatggtatttaccctgttcaaaaagccttagtgaggttccagctttgaataagatagagtaaacatactgtgccctgtctgtcctactgaatacaactatcaaacctggacaaaacacatgaattatattttcaaggactctgaaaagtgaattgtagcagacggactgagaaagaccagacctgaaaataaaacaaaaccaggcgtgagtttaccatgtttatcctctggaggaacccagctttgacttgggaagctcagaagtagacatcaacacaggcaggaagagcttcacctggcagtgacggtgacagcagctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggaatagacctaccattttctagataaagaattggaaagaggatccacaggtaaccaaaaagtaccagggaaatggcagagaaggaaaacctcaggagaccaacctcataagtggtatttattagtgcctgggctcaaatccaaattgtacatgaatatgtctggtcctagatagggtaccgaagactttgaaagtgaattttggtatatcattgcccagattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctaggaaaaagaaaaaataaaaaaataaaaagctgggcatagtggcatgtgcctgtagtcacagctacttgggaggcttaggcaggaggattacttgagctgaggatgtcgaggctgcagtgagcacatcactgcactccagcttgggtgatagagcaagacctaaaaattaaaaaaaacaaaaaacaagacttagagtctcataatattcagtaagtctagcatataatgaaaaattgctcagcatatgaagaactaggaaaatttcaacttgcatgggaaatccaacctacattaacactgagatgacagatcttggaattacctgactgactctaaagcagctgttattaaaatgttccaatgagtaagggcaaatctctttatatgaattgaaaggaagaaggtctcaacaaagaaataaaagaaatacagacattttatggtaactttagaactaaaaaacacaataactcaattaaaaaaaaactcattggaaggctccatgaaagtgacagaggaagaattggtgaatttgaagatagattgatagaaattatttcatatgaacaacacagagaaacatgatttcaaaaaaaatgaacatagcttcaggaagctgaaggacaacataaaaaggtctgatatgtatggctttgaaaatccagaaaggtagaaagagtgcagtgtgtgtgtgtgtgtgtgtgtgtgtgtatgaacatgtacacaaacgtatataaacacccttatgtttgaagaaataatggctgaaacatcccaaattagccaaatcacataaacctacagattcaaggacctcagaaaactcaaaataaacacaaataaatccatgcccaaagacatcataatgaaactgctgaaaactaaagacaaagagaaaccttgaaaaaagcctgaaaaaaaatgatatgttccttgtggagaaaaatctatttaaataacttcaaatttcttgtcaaatttcacagaagctaaaaagaaatcaaccaacattttttaaatgctggaggaaaagaactgtcaagtaaaaatattatatccaacaaaaacctcctcaggaattaaggcaaaataaagacattctcagattaaaaacaaaataagacaaaacaaaacaaaacaaaaacccaaagataccctctaaaaagtttgctgaagaaattcttcacacacaagaaaataaactgaagagcaagtttcatgaaagaacagcagaaatggtaactatataaataaatatagtacatatcatccttttcttgagttatttaaaacacttgagagtcaaaagcaaaaatatgacattggctgatacagtttttatccagtatgcatatttaatttaaatatctactataatataaaaggacctatatgatggtagtaggattcctgcattctacttgaaaaagtaaagtattgattctaaatataacatgaaaattaagcatgtatatagcaatccctggagcaaccaccaaaatttttttttgtatacacaaagagatacagtaaaaaacctgatatacttcggtggaatgctaaaaataatccaataacacaaaataagacagaaaagctaaaacagaggaataaaaatcagaaacaaccagcagaaaacaaataatgaaatggtagacttaaatccaagcatatctatacttgcattaaatgtaaatggtctaaagggccaatttaaaggctaatgattaccagaataaataaagaaaaatgtatgatgcagcaatatgctatgtacaaaaaatcactttaaaataatgacaaaggtatgcccaaagtaaaaaggtgggaactataaaccatgcaaacattaaataaaacaatactcaggttgctatatcaatattagacaaaatagacttcaaagcaaggaaaatgactgggaataaagatgacattaaataataataaaaagaacaatttactaagaagacataacaaccttaactatgtctgtagcaaacagcatagcatcaaaatacgtgaagtagaaactaacaaaaatgaaaggacaaacagaaatattcacaattatactttgaagattcaacagtactttctagaaaattgacagaactagtaaacagaaaatatgccttgatatagaaaagctgaaggaaaaaaccaactgactgaatatagttgatgtttttctcactctactccaaaacaatagaataggcattcttttcaagtgcacgtggaataatattacatttatgaagatagacctcattctaaataataaaacaaatttatggcaagttcatggaattgaagtcacacaaaatatgttttttgtccatagtgtaattaaattagaaataaatgacagatgccaggggaaaaaaattccgaacagtttgaaattcaacaatacacttctaaatactctacagtcaaagaagaagtgtcaaaaaaaaataaattatttcaaactgcatagaaatgaaagtacagcatatcaaatttgtggaatgtctgcaaagcaatgtttggaataaaatttattatgtaaaatgctcatgttatgagaaaataagttctcaaatcaataatataagcagccaccttaagaacttacataaagaaaagcaaaaaaaaaaaaaaaaaacacacacacacaaagcaatcagaagtaaaaataataaagagcatacatcaataaaactgaaatcagaaaaacagtagaacaaattaatgaaaccaacaggtggttcttgaaagagattaatcaaattgatgaacctcttgcaagactgacaggaacaaagataaaacacacaatatcagaaatggaagaatcaccactactgacaccatagcattaaaagcataagaaggttatgtgtttatttatgtataatagcaataaataattagcaagcacaacttaattagtaatttcacttaaaatagctttcagaatgtgaagcacttagacataaacctaacaaaacatgtacaagatatgtatgctaaaaactacaaaccctcatgaaaaaatcatagatgacctaaatgaatggagacatgtaccttgttcatggattaaaacactaaacttgttaagcatgttaattctactgagttgatctatagatttaatgcaactccagtcaaaatcacagtagaatattttgtagatatagacaagctagtgctaaaattcatatgaaaaggcaaaggaactagaacagccaaagcacttcttgaaagaaatggagaaattatgtgctcaattttaagaattattaaaaagcttcagtaatcaagagtctggtatcagagacgagatcagtgggtcccatagatcaatgggacataaatagacctgcataaatatgccaactcatctttaataaagatgcaaaagcaacttactgcagaaagggtaatgttctaacaaatagtaatggaacaataggaaacaattggtatacagaagaaaatgcaacctaatcctcacatattatgcaaaaagaagctcaaaatggatcgtagatttaaatgtaaaacacaaaattataaaatgtttagaagaaaatcttcatgacctagagttagggagtgagtttgggcatatctaagaagaaaatatatgtatatatttgataatttaaattggactttatacaaatttaaaacttttgctctgtaaaagacactataagagagtgaaaagataagctatagacagaaataaaatcttttcaaatttcatattcttcaaggggtttgcattcaagatatatttgaaaactcttaaaaatcaatggcaaaaatacaaagaacacgatttaaaagtgggcaaaagtcttgaacagattgtcgaccaaagtagatatggggaaggtaatcaaacagaactatgtgcaacatcattagcttaacttagggaaatgcaactaaaatgataatgccatagcactagaatgataattataaaaagaaaacaaaacgaaagaccctttcactaccaactgctggtaaggatgtggagcaactagacttcttatacgttgattatagggatacaaaatggcaaagctgcttgaaaaatgggttggcaatttctcagaaaggtgaacaaatgcttatcatatgacccatacatgccattccttagtatttatgctagcaaactttaaatttatgttcacaaaaaaccatatgtgaatatttatagtagctttgttcatatttgtcaaaaattgacaatcatcaaaatgccattcaacaggtgaatagaaaaacaaactgtggtatctgactacttcttgtcaattaaaaggaatgaattattgatttgtgcaacaacttggatgaatttcaaaggcattatacagaatgaaagaagtcaacctcaaaaagtttacctaccatatcatatagaatttcaacaaggcagagttatggtggaacgaaatcagtgagtgccaggggttggggtgggggaaaagtgtgactacaaggagatagcatgggaggttttgggggaactgatggagctgttccacatcttgattctcatggtgattatataaatctatgcatgtgatataattcataaaactatgatttatatgactataaattaattttaaaaataaaactagaagaaaaaagtcttcccaatgcttgactattgcttttagattatcctctaaactccatagcaggcaatgaatggcttccattctctggctacactcattttcccaacgtatttttttgcccagcattgttgtgaatctgttctcagtgtctcactcactttagtttttctctattccctaaagatccgagttataatatacaacctcaccaatgctgattatttgagaccagcagcatatctggagctggttaactgacagatgtgattggttggaactttacctaattcacccaaggcacatttggttttcaaagacttgaaaagggatcaatgttctcatctgtgaggttttaagacttttgtaggcgaggatgaatttcattctactgacaacctgaacgttttttcatgatttcaatacccctataaaaagataaaggcagctgggaatacttactctagaagaaatatggttgaaaggagaatataaaccattcacataaatggtaaataagtatttgtcatcttaactaaggatacaaaaaaaaggaagtgtgcatcaattataccatgatggattaattgtgctgtatggaaaaatttcctattaaggaaatttgtttaccttcctgaaaagtgtggctgaggttggtcacagagttgttctctagatctctttaaggatagattcctttttattttttaattgacaaaataaattttatttacttactgtgtacaacattgatgttttcaaatatatatacattatgaaatgactaaattttatcaaattaacatatgtattacattagatagttaccatttttgtggtgagaacactttacatttactcttttttttttaagaatacaatgtatcattaatgatagtcaccatggtacaataaatatctgtaatttattcctcctatctaactgaaattatgtatcctttaaccgacatcttcctaacacctccaatcagttcaatccaccattctgttctctcctatgagatcagcttttttagattctgagtatgagtgagatcatgcaatatttgtctttctgtgcctggattatttcacttaatacaatgtcctccaggctcatccatcttaattgcaaatgagaggatttccttctttattacagttgaatagtattttattttgtatatgtaacacatttcctttatccattcatccactgatggacactgaggttaatgtcatatcttgactattgtgaatggtgctgcagtaaacacggtaaacacggaagtgtaaaatatctctttgaaatacttatttcatatatatgtatgtatatatatgtatacatacatgtacatatatattcatacatatatgtatgtatatacatatgtacatgtatgtatgtatgaatatacatatatgcatgtatacatatatatgtatgaatatatatacatgtacatgaatatgaatatatgtacatgcatatgtacacatatatacatacatatatatatatatatatatatatatatatatatatatagtggtgggattgctggatcatatggtagttctgtttttaattttctgagaaaccttcacgctgttttccataatggttacactaatttccattcccaccagcaatgcacaagagtcccctttcctccacatcctcactagcacttgttatgttttgtctttttggtaaaagccattctaataggtgtgaggtgatatcgcattgtgacgttaatttgcgtttatccagtgattagtgatgttgagcatttttcatatgcccgatggccacttgtatgtctttttttgagaagtgtctattcagatattttgcccgttttttaatcgggttgttttgttgctgttgagttgtttgagttccttatatattttggatatgaaccccttatcaaatgtatattttacaaatatgttttcccataggatagatttttaaccgtttgggatggtttaagggaggccaaatggaaagcctaaaaaaagagcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctataaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgccctttcagtgagaattgagagccctggtgaaggcagatagaaaagcccagaaacacttgttgttttatttatttttcattgagcctctggctaatttttgataaggtgtcacagatttaatcagttttagtttaaatagaagattgagaaatactatcttcttttcattaccattagaaagaaaccttaaagcttaattttgactgcatgaaatgatatctaacagcaaatatttgtaattggtgtattccagatacttgtagtgtaggaaatacaatattgttttctttaaaaggaaattgggtgtgtataaaacatcagaggaaacaaatttaaggcaagattctgaatgacagttctgtattctacaaacctttgctaatgaaagggaagatgatgattttcaatgtaggtcatggcctgaagtggagaatttctgaaattgtcattgcagaccctccaatcagcctgatctgtctctgcaacactcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcctgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctcttttctgccagtagataggttaggaagcagctggaaggtaacatcgtgtctgacttctaggatatcacaccttcaatgagttattgttttattgttccttgggagcttccactgaacgtggtgttctgtcacttctgaaactctggggatttcttttcatgatagaaaattgacaactagtatttttttaatcatagaaggtaagaattgtgcttattgaccaaacatgtgatcaaaagtggttagaaagtctttagcaggtgtaccataaatgcctgccaccttcccatttccacacctccacagacagcttcttgtgaataccccctccacacatacccaaccatacatagtgttctctctgctaagaagaaaactgtatacagaccacatgacctcacctcactttcattctcctccgtacccaaagctgagactatggtggccagtcatttgtaagctgtctaggcacctttgacatggcattgtttgaaaagataagaggttatctttggggaatttggtatgaaggaacaaagcaatgagcagtgaagatgaaagtttatgtgacagaggctgagatagccatcatggggaatgatttaagctgaaattgtgggaaagtagaaagtatgactatgaataagtgtaatgtataacataaagacagatgatttataacacagagaaaatattacagatcagaaaatgaaaaagccaaaggggagagataagagagtggaatcgatttctgcgtaggtagagagtttaatataaagtagaatatggaatccttccatgttctccctcataaaattcacagaaacctcacgacttaccaaagatgccaagaggagcaggagatgctcttgtgtttcacccaaatatttgtttctcattttttttaatgaatgtgtgtattttctagaatgaatataaaggaatgcctcattcgtttatgtatttaaaatacgtcttgactaccaataatgtataacaacctctgctagactcaatgctaggtccagtgcatgcacttggaatccagggacccaacttggaagggctcacagtcttatgttaggagacagataaggaagcatatttatggggcacatgtgagattttgttacatgcatagaatgtgtagtgattaagtcagggtatttgagatgtccactactttgactatctgtcatttctatgtgttacatgctgtgatactgataaagacagggtatgtaaatgtgggagctcaaaggagggacatctaactccaacagtttgccagttgtggggaagaaagggtaaggaagtttcctcaaataattacatctgagcagaattatggcatgccagcaacctcagccaggtgaagggcaaagagaaacatttgcatgagagcctccagggaggtagagaatgcagtgttcaggaactacaacaacaacaacaacaacaaatcaagtattcctgggccacaagatgtgagagggggaatgatgggagatttgctggagggcagggggattcaaataaaagaccagcacacatgagctggtttgtgacctactacatagttttgacttgatccttacaacatagtattttaagttaaagagagagaagttcatatttgcagcggggaggtggataagtggttgttgagacattaaaatagtagagtttactggacttggaagacttagcactggacttggtaacttagtaccttgatttctggcatctcagtgagttgaggccacatgacaagtaggaggaagagcagttattatcaagagaatgcaaatgactgaaatgttgagttggggtttctatgggatatactggtagatagcagagtcagtagtaagatacaaataggtctgagacacaggagagaatctcaaaagggatattaagcttccatctctgtaagagccatatggttgggtagttggtttgctttgtgctatacaactatttgaagttctttacattttctttcctcctgttttttttttttttttttttttgaaacaagatcttgctctgttacccaggctggagtccagtggtgtgatcatagctcactgcagcctcaaactcctaggctcaagcgatcctcccacctcagccaactgagtagctgggactacaggcatgtgccaccatgccccattaattttttatttgtattttttttaaagacaggggtctcacggtgctggccagactggtctcaaactcctggcctcaagttatcctcccacctctacgttttcaaatctaaaaaaatagtttaggacgtattcaccttagagatttaagagtttatattttagcaagctgtaaagtccagaaatcaaattgtgagtgggcaaacaaaatcaaagcaagtttcatctcatttagaaatgtggaagaatgagaacccttagtttaccttgcttttgtgcatgcagagtgctagctgtaatgggttagcacaaaaagacaaaatcctaaatcacagtcactttgccataatttttaatagttatgttctctcatagttctatggatgacatgctcattatagacagtctgaaactgaggagaaccagggttcttcctacatgtttatgttgaatgtggagaaggtgaggttactgcttctgctgcccttttcagctcaacatttgatctggccaatgtggttagctatactgtgtctcctaccaccacacatactcagaaaactgtggtagtaaacatagaatgaacttccttaaaagtagaaaaccattcattggctaaggtacataagaataagaatgaatgatgaaaacattggtagaaatgctgatggaagaactgattgatgcagatctattttggagaccccttaactgccaggggacatgaattgcctggctggttgaattgactctagaaatgatgctctgtggccgctaagtctccatatttgaccaaaaggtgtgtgagggctgtgtccatttcatcacttgccatgagtcctcagggctagtcagaataccaggccgatacacgcttcacaagcatgtattgaatgagtgaatgagaaaatgaatacaataatattttcactagtagccatggattgaggataaaattaataagaagagcccccaggaagtccggattgagctttatgctctgggacactcttctgctcagctttgtggaataatttgcagcactagaaatggacttaacaaccaggatgagggggtcatgttttggggatcaaacctcttttcatcatgaaagctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgaggagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgattacagaagtagtattggctcattatcaaaaataaatgaatgaaaaaatatagacagttaaaatgtgatataatgtaatggcctaaatatgacattgttaactgtacattcctgcagttacaattgaagatggcattttatcccttaatcagatacaaagaactgttagaaaacttcctttttgcccaccactgcattgtatactgtggtatatatggaaattcccaatacagacatggaaatgataaataaacacaaggggaactctcacggcataactctgtgtctagcaggctaagataataccatgttgtgcagtggtggtaattagagcacatcacgtgactctgagtttttgagggcagtggtcaatatctttatctttgtatccccaagggtgttggctaaaatgttcagttagcactttgaatgagggaatgcttattgagtaaaaagtcaattacatgtgacaataaatgcagtaagaattagtcaagagaaagacaagtgtggcctgcagtcaccaacagaagctttaagctccaaggatacccaaatgcgtatgttaatcatgtgttattgttaaagcatttagatgatgatgtttggaagttgtgtgcaaaaccaggaaaaatttgaccaagttttggaagttcctttctgtttgatttatctgctgttatggtgttagggctattgctgttttatagatcagttctacactgtagtaattaactgggtaatgaagacaaaaagtatttagaaacactctgacatatcaagaaattagtgtcaccaacccagaggcttctctgtctcttcagcataatcttccatctcaggtatacctaaacttgggtgtttactgcctcaaaagcaagcatttcccttgaaaagcagatttctttctttctttttttttttttttttttttttttttttttttttttttttttgagatgagtctcgctctgtcacccaggctggagtgcagtggcacaatcttggctcactgcaacctctgcctcccgggttcaagcaattctcctgcctcaacctcccgagttgctgggtctacaggcatatgccaccatgcctggctaatttttttgtatttttagtagagacggggtttcagtatattggccaggctggtctcaaactcctgacctcaggtgatccgcctgccttggcctcccaaagtgctgggattacagagagaagctccagcttttgcactagctgaatgttgttatacttcctcaaacatttgaggataaagacataatatgtgatagttttaggtgactttttgtgtgtaacatttgagctctgaggataataatatatctttctatataacacatttcaatatctatttaatgtgccagttgcaagaattttctgattgacattgatcattttcattcagaattaagtcatttccttctgggaattaatataatagatttattatatgcttatgggccttgtctaagctctcttctccacactgtttcttcaaatgtaattccattgaaaatctagctgctgttttagagattacagtaaggcaaagcatttctcagaagacaaatatagaacctaaagttactataatgacatttggcaaattatataatctgagttcattttttttctcttctctccctcctcccttgtcacaaagcctataggaaggtatactacatattttgacacttttttttttttttgctttcaatagctgtgttcttactcaccactttaaaataacgtctttcttatatcttttaactcagaggtatactcagagactggaagacttgaacggggactggctacccagatagagcccccttggtggtgttttccttggtgatatgatactgggccgtattccctcaggattgcagggtgagaactgtgtctttgctagcagactaggtaggagaggatccattcctcagaatcaggttcatgttaacatagttcacatattgtattaaatacaaaccagaatgccaagttttttatttacaatgagcaatatagctgttaaataggctatggcactcaagtcaacaacaattcacagactcctctccccatagagaagcaacatggggatccaaattgtaatcagaatgccaagttatcaatttataatgagaaatgcatctgtctgacgagaatgttgagttggcctgataaattcattgtctccctgtagattagtgacaggggatgccaaattttcggaaagttgcgagagaatatggctttaaaacaatgggaaggagttgatcttaatttctgtcttccaattaagatggttttaacattcccacctctacctggctggccttgccgagaaaacaatactgctttagtcaaacaatactgctttagtcgctgtgaccagtgtgggcaataaaatgtttattttctgcctttcctttttctttgcttttctcaaccaactacctctctccaaaaatgtgtatgacataattgattgggcttttgtctgtcatagtattgattcatcgagcctcaatcatatttcagccttccagccctagaattactcccatattattttttactggtgtctgggctatgttcatatgtgccaatcaaacatgtatagtttactgacctaacctcacatttgtttaatcatatcctttatttttaaattctgtaaatcaactcactgcagtccttggcactgaaaatacctctatttcttcactacatttcctgaagtggcaaaaatgccaagattatatgagacccagggggaaatatagtgttctctgcccctagtgtttaatgcaaattgaaactaaaataaggcttgctttgaaaaagtacaaaaataaattttaaaaaatgctaaaagctggattcttctcttttggagatggcaaagagatagtaaagttgataaagagatgatttgggaaatgcaggtactttttagcattagtgagtagactcatttctaacatctcctggaagtatttgtgaattggctccagaatcttttgctatcacctaccctacaattaactagggatatgcaatcaccaaatacagtttctgggacaccttcaaagatgtcagcttcttcaccataaagatggcaaaaagtagaataattacattctatctttgacctttgatgagaaatgatcagtttctttttctaatccaatatggcaagcacttctaattcgtgtgaatagatctctttatagacatagtgtgtttatatttaaatactaagataatctggaattctgaagctacaactgtataatgacattatacttggtcagctattgcttttcttttcccatttatttattttgcattgagtcctacactggtgaaaggcctggtgcgttgcattgagttctgcatgtttgaacttcacaaaggttcaaaggtgtgcacatggcctggaacgataaacatttgtcctaaagtcattcttcagcttctgacatagcttgtgatttaattgccacctcattaatatgggccactgggtgtgaatttgtcaaaacaagatacatcaggagagctgagtgaaatgtttcatgttcagaggtttttaccactcctgttccccactgcccatgttttgtaaacttttaacttcaagagactggtttaataaacatgccctgtcttctaggtcattgggttaaggatcatttcagtctttttgaacttttcacttttcctgtgtaagtataagctaagtacttattgggttctaaagctaaaagcctatgaagataaagggccttattgaaatagtgaagtgagcaaaatatctttatggttcctgaccttgtcctcctgggctttgtccttcttttaatgaatgacaccttaccctcaggttcccagtatttacacctttgtagtgtttttgcaattcagaaaaatgtatttgatagatgagtagggtgactgtcgtttacaataatctattttctatctcaaaatagctaaaagagaatagtttgaatgtttctagcattaacaaaagacaaacatttaaggtgatacatattccaattataccgacttgatctttacaagttatacaaatgtattaattcaccacgtgtagcccaaaaatatgtacaactattaagtatcaatttaaatttttttaaaaggacacagtgaaggaccatacttaaacttgattatttaattgctcatcatgaaattttatagggaaagaagaagaaaatcttcaataactcaaactcataagtaaagggacatacatggctgtatataaaggctatttataaagccctctatataaaagttatacatagcctataaaataaataaggatctgactttatattggtacctggcacaacacatgcattgcacacaggaaccactccataattacaattaaaattattatacacacaaatacatatttacttcttatcaaggtatcacatgttaatgctcacatgaagcagtatcaaaataccgccaatgagttgtagaagtctcttgctctattttcctcagtggcattctcactccctagtgaagtgtttttaattatttttatttttttatttttttactggctattttagactttctggtagagcactcaataatttctggatctgtcagagttaggcaatccactctgcaattggcaagatggggattttgctcatttatacttgactctccttcttctattaatcttctccttctatttatataactgtaacatagctgcaagctttaagtaaaacacgtaaagtcattttcttgttctgatgacttgcaatattttctctttattccccacgagatgaaatgaggatcttggtcccatacgctttccccaacttcttctcactcatttcaggccctacttctgtcaatcactctttctgtgtttagattgttgatatttgcacgttctgctaaaaatacaatcatctttgcccaaaggttaactttaaaagtagaacaataaacagtattaacattattatggccacataaaaatcatttaatgttaggtaaaaagtatgttaggattacatttttttaagagaccaatgtcatgacctctaactcactgaaaagaaaagattcctagcatttgagttcaaataaatgtttttttccttatatttagtcaattgcttaaaattaagctgcatttcttttatgtattctattttcctgcatcatatcttcatatatatttttttactctctatcatattatctagtctatttggtctgctttcccccactccaaatatatcccccttctagagtcgtctttctccctactccacactggacttacaactcctagacatcgtgctgcatcgctaatgtcctaagtttggtgttattggtgctatcaatcttcttggttagatctgatattttggtagcttcctattttttgaattatcctcttgttttattataatacatcctaaagtaacttcctaagagaaagcacacaggaggtaaatgttctgtttcttgcatactctcatatttgtgtgaccctttggccgacgatagaattctaggttgaaaagagttttcctttcgaaatttgaaagctctgctccattgttgttgatgagaagtcaagtactagttttattcctcctgtttccctttaaaaacttttaggagcatctcattattttaggtatttacatgttttcgatgacatacttgagaatcctttttgcacttattacaatatacactcaaggaaacttcttggtttatagattaatgtcttccattgagctatgggaaactttatttctatcttttctttaatatgttctcgcctccattttctctcttctctttctctgacttttaatatctggatgttagatcttccagacttatcctttctcatgacttctgtctttatactttagtcaaattagtgagagtccctttactgtgtttactccctctacttttctattttgtttattccaacaactgtgtttttagtttctaagtagtctttcttgctctctattttaattgtccttaccttctgtttttattttttggttataatagtttctccaatttgtgtaagtttattagagtatcttttgtctttgttcatttatttcttacactattcctgttttcatcttgcctgtcttagtctttatccataatattgccagatctcctaatatatttattattcttgctggtctatttgtatttaagggaaacaaaaatggcagactgcttttttttttatctaatagaactatttacacttaaaatctttatccttagtgagaactgtgggaatagaggaaacagagggaggggcaggtgatccaatatattaaagaggtgaaatttggcatcaatgagcctccaccataaaagaatgtgaaaattgctattcccagatgccaacatctaactaaagccttgcttttctactgggaattagttcaatttttttagagaagaacaaacaataatttttgttttgctttgttttggtttttggtttggggggttgcatgattattattttcttggatgattattattatttgcttgtaattgttcctgctgtttgtttcccaatatctcaaacggagatatttggctgcacaggagaacaacatatgtagctgtttcatacatggagcttacattgggttttgttttcagtcatatcttttatttctacccttggactccctgaagtttttgttattctttttatttctgccaaatctcccaccaatttcgtagtcaccttatagcatattttagactctggttttctgcctgttacgttttaaaatggagcagtaaacacaattatgaccacataactaagttaaaattgagtcaaaaagtgtgctaagattaggttttagatttttttttactttcagggaccaatgttgtgaacttcccatcacctatcttcatcttcatcccaaaatagcacaccctttcttggttattatgtacttcttttgtgttctgctaaactattatatactatacttatgctttcaaaataattcatttatatataattaagttttgtgtaaatatttaacatataaatatttagtagaatctctgaaaggagtgaaggcaaaaactttcctgacccataataattacatacctagagcatcacaaaatctattatcaatgaatggattctgaattctttgataacatgtctttaatttttaggatttaaagtacctcctttaaagcaccagaccagtagtcaattattatgatactcacctctgatattgtcttatccctgagtgtgtaataaacttctggtccctggaatttctcttccctcataaaactgtttctcaatgtatcattttgtgatgacttttttttctgagcttcctttacctacccaataggtacacattttttcccaagatgctacaacaataccagacaattccagatattcccgccttccacttgtgatctgtaaaatatatatactggttggttatgtgcaatgttttatgccctatgccctttcactggtgatgttttaaagcaagcattgtagatgaccatgaattatagcagacaggttcccagtcctatgctgtttcctaatgtacattttttctcttgtcacaactaggaaagtcacgtttcagtgttttggttttggtgaatgcccacaacaaggctagtgaaggaaggaggcatagtaggaagctgttggccagacgagcttttagaagacccttgctacatagagaggacgtagaaaatgtctttatcattaggtgagaaacatgaactgcattctttgttgcgtcatattaaaatgtaaatcacaagaataaattataaaaataaaacctaaccaaaacacaaacaggaggaggtaacagaggacagaacagagttcctagaaaattatattacaggacagacatacaagtacccaagagaaagcaaaattctaaaagtctcttagccaagtgtagagcacaaaagttctcctcagttcatgcactttcgaggcatgtcagttggaaaaagagcatgctataggagacagttttattgtgttttgtgcagtgaccttttaaaagggaaaggtcctttctgagatattttgagttcactcatgcatctgtcatagaatttgcttggaacgaagtgtgcctgtcaccccaacctttcttcagagcagagcctgcttcctcatgggaagaatgatgttttaagagtgtcattcagatggaacagaaagaggtcttctccaggtttgtcttgctactgaatcaataggatctcctggattttgaaaagtatattaaattttttttcagacgtcagagttggggggaactagttttgtttagctttatacaaatttctagcattacttgtacggatatgctggagattctgctgcctcttgcaatctgacagcctcatggagagttgaataaatggtcattgcctgggtaagtgagggctctttctaaagtgttcaagagtaggtcacatagagaggagtgccttcttcctgcattttttcaagtacctgttttcccctattttattcttttggaagggattgattttatggtagtccctttcttttctcacctcttgacagaatgtttttctaaatgattccttcagattattctttaggtcccattaaaagaaacatgctggttcttcattctcattctgtctttatgcttaatgcagatataattcatatttgttttatcaaagtcatttgataacctcttcaatgacaaatccctgattacagatgtattctcttttggtaacccacaggggttgaaattgctctaatttttggtactgtgtattaggttgagattaaaaaaaactttgaggacaatcttttccttatttaatatctggagaaaaaatactacatgtgagaaaggtggaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaaagattccacattactagttatttgtaatgggtaattgcacaatatactgtattgttcaatctggtgtgaatgaaagtggggagatcttgacaattgtcttggaacaatagatgtaaaattgagactattctgggaaaaccaggatgtttgggccccctggtaatagtctaatcattatacatctgtgctataagcacacaaataacatctagtaatgaaagaaacattcagctaagaaaacttgcagtcaaaaacttttgataaagctgtgaagacttgttaggtcatgtattaatttaagatctttaagatggagagcatcccatcaatgattaggagaaacacaaacattttatattgtgtttaatacacttttttatgtttaataaaaaacatatcacctaccctacaactcataattaacttatataaagttttttttgtttaataaacatttcatattgtgtttaataaaacgcaaacattttattacttacaggtcctgggtgggggcagtacgtggcatgcctggagatgacacacaaggagatcaggaagtgtgggcagggagaatgtggacctgggtcacttgtatttattggagtccagggtgagaaacctaagtgtcatgggacgaggggagcaattgggcagtttaaaacaagcaggcacaaaatttcaaacaacccaacattaaaaaccctttctggcaaagaaatgttatctagaaatctagctgacccaaaggctgagtgtgtgggtttggggtaagagctatcttgcctcaccagagcaacaaaaaggagaagtcatcggctaagctagatagccaaacaaaatggatgctgaggcaacattaaattataagaattataaggtcaagatgggatggagattctggacctggtacaaggaagtgctgcaatgaatagcagggagttagggcagactacttccagtgtcctgagttttcaggtttcatttggctgtcaaaaccatttgttccctagactgtgatttgactggtgatgctggctggcagtgcccctactgatgacttagcagatgactctgagctgacaatttgccatccttcagctgtcttggtaggagggattcagttaccagcatgcacagcacagagcagaatccaacctcatagattttcaaaaacttatcgctaaagtctattattaacagcttggtaagaaaagtctttttcattgagaaatgtatagattattgtgaaggaaaagtatttgctaagaccagactggccgaagctaatccttttgggaatagccttaccaatttgggggaaatgactcatttacttataagctatacctgtcagcttccctttactacctttgacagctcttaaaccagcagtataagaactgctagtgaaaaaataaacattagtataaaactttatgtacctattacataacagtcatatattaggtgtccattttaagtacagatactgaaatagcaaaataatttattggagaaactcaaaatgctatagaaaaatttgacttggaaagcaccacaaatgtacatgatacaagtaaacttgaagaaaccaattacattgggggatagtcttgttttctgttattctgtggacttgctttattaatatatggaatttagagtttcttatatttaaaaaatatgaaaatgcacataatcattcccaggctgctcctgatcctttagtgatgattcctacagaaaaaaaaaaagtgcttgggatggggaagaactttgtggccatcgattttttctttctttctttattatttttatttttttattatactttaagttttagggtacatgtgcacaacgtgcaggtttgttacatatgtatacatgtgccatgttggtgtgctgcacccattaactcatcatttaacattaggtatatctcctaatgctatcccttccccctcccaccaccccacaacaggccccagtgtgtgatgttccgcttcccgtgtccatgtgttctcattgttcaattcccacctatgagtgagaacatgtggtgtttggttttttgtccttgtgatagtttgctgagaatgatggtttccagcttcatccatatccctacaaaggacatggctgcatagtattccatggtgtatatatgccacattttcttaatccagtctatcattgttggacatttggcttggttccaagtctttgctattgtgaatagtgccactataaacatacctgtgcatgggtctttatagcagcatgatttataatcctttgggtatatacccagtaatgggattgctgggtcaaatggtatttctagttctagatccctgaggaatcgccaccctgacttccacaatggttgaactagtttacagtcccaccaacagtgcaaaagtgttcctatttctccacatcctctctggcacctgttgtttactgactttttaatgatcaccattctaattggtgtgagacggtatctcattgtggttttgatttgcatttctctgatggccagtgatgatgagcattttttcatgtttcttttggccgcataaatgtcttcttttgagaagtgtctgttcctatcctttgcccactttttgatggggttgtttgtttttttcttgtaaatttgtttgagttcattgtagattctggatattatccctttgtcagatgaatagattgcaaaaattttctcccattctgtaggttgcctgttcattctgatggtagtttcttttgctgtgcagaagctctttagtttaattagatcccatttgtcaattttggcctttgttgccattgcttctggtgttttagacatgaagtccttgtccatgcctatgtcctgaatggtattgcctaggttttcttctagggttttaatggttttaggtctaacatttaagtctttaatccatgttgaattaatttttgtataagatgtaaggaagggatccagtttcagctttttacatatggctagccagttttcccagcaccatttattaaatagggaatcctttccccattttcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttctggcttagtgttgacttggcaatgaggactcttttttggttccataggaactttaaagtagttttttccaattctatgaagaaaggcattggtagcttgatggggatggcattgaatctgtaaattaccttgggcagtatggccattttcatgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttatgggtggataagaatgcttgtgatttttgctcatcgattttgtatcctgagactttgctgaagttgcctattagcttaaggagagtttgggctgagacgatggggttttctaaatatacaatcatatcatctccaaacagggacaatttgacttcctcttttcctaattgaataccctttatttccttctcctgtctgattgccctggccagaacttccaacactatgttgaataggagtggtgagagagggcatccctgtcttgtgccagttttcaaagggaatgcttccagtttttgcccattcagtatgatattggccgtggatttgtcatagacagcgcttattattttgaggtacgtcccatcaatacctaatttattgagagtttttagcatgaagcgttgttgaagtttgtcaaaggccttttctgcatctactgagataatcatgtggtttttgtctttggttctgtttatatgctggattacatttattgatttttgtatgttgaaccagccttgcatcccagggatgaagcccacttgatcacggtggataagctttttgatgtgctactggatttggtttgccagtattttatggccgtcaatttttgaccctgagagtgaacctcacctttggaagttactaccaagcatttgacttttggaagactctttacacagcaagagatctcctccacctttgaggtgaggacattaaacttggtttaaaaaattacttttccaagtacattaactatgtcttatatattatccatacacgattactaagaaaatataaacattttttcatatactggttaattggctttaaagaaaaaaatcccctttttaatcccatcaggatttagtttgacaaatttttcagaaacttataaagatgaaaacacctggatgtatttctctgtaaactttggctgttagcatcctttttcaatgcttgtgtagtttttcagaacagaacctaaccttcaagatgagtcatttgttcccaaacttgaattgtcatgaaacactccttgggtttccctcccgtgctgaatatgatttctaagaatgggatggcatggttactgtataaagatcatttgttctacaggtcagaaggcctgagttctcatcattaattaactttgtgatgtatgttgggtaaatcacttaacctctacagttttatcttctgtaaaatatgaaagaaagactttgagctaaagtttgtttctactgtaagaacatgagatattttatcttggtgacatcatggcttatgggcaggctgaggtgggattagtaattgcaaaagcagtggtcataaggtgaagaaacctggacatgacttcagacttaacctgggaaataaaatcagggaatgtggacaaagtcagacactactttagcacaggatgagatgccagaagatgatggatccaacaaagacatgcatgaaaggccacggggctgtttctgggcttaaacaagctagtcttaattaggagaaaaagcggagggactggaggagtggaggagaggaagtcaatagtgatgcagtacttccatcctagagggtttcttcgagagccaagagttccaatctgtgcatggcattaccccttctgaggtaaaagaaaaagtcctctacaaaaacctgacagtattctgccctcaagccccttgttaaccaggccaaggtgaggcatgggtttcatgccctactgatagcagtgcaagatgtcttgttatgagtattgatatcgaagtatgcttttaaatcatatttcactctgacaccgttagctacgtaactaagtcttagtgctattgccagtggtccaatctaaatgatgtagtagagaatctagttcattactctgagctgggactctgatgaagatgtagggtgacacactgtctttgtgaagaaggcatgtgtggaatacttggtgtctttggtgagatggcagaacttaaaccgtgaggaggatggcaatcatgaggaatggtatcaggaagtttttccagcttgatagatgggaaggaaagcagaatggcaggaagggggccaggtgctatctccttgaaggagggatgaaccgtcctcagggtctgtctgctcacaggcaggagacttataccagaactgtgtttactggaagtcttttagagttcaaagtgaacttatctgagtttgacaaataatcccctacagcaagacaaagagtagtagatgaattatacatttggatactgttggaaagggagaggtaaaatccaagttggaataaagcatatgttatgggagatcatcaatatcattgagcacgggctttgaggattagagttatgatgaagtataatagtacagaatcagcttgagacacagtcttatgtttgttttggtcatctgcctagaagtaaggtgcagaaaatgcttatactttgaaaagtcgtgaattaaatagaactttctagcaatggttgatgaactgggtgggtgtcaaaaatcaagacttcatgattgggaagctgtggggatggggaattttcttagaaaagagagagactctaaatggtgctagtggggtggcctaagccctgacagtggaatgggacctttttggaagactgcacctcggggtaaggatgcttgtgaccctgagactagcatcaacccatgatagaacccaagggtgcagaaacctatgatagaaagcaagggtaccaaaaccttgagggtgttggcagactgaggggcactcagttcacccagggacatccttcacctgagaatgacttttctagatctccctgcagtggttttgagaacctgagtcctagttgagccttctgtgatgccttccaagtcctagcagtgtggcgtgcccacacatctttctcaacaaaggatgcagaaataggaatgtaattagagcagttcatcctcggtagagagtcctttgtggttcccagctgggcagtagtttaaaggatagccctgtgaatctactcaaatagtatctttatttaagatgtcaataaaaggtagtaaacttgagaatctctgagaagcattgatccatagtggaaattacatgtatttaagtatgaaggtagtaaatatatattaacaacacattatatgccagatactgtcctgggtatgagctatagctggaagtcagagcggtacaaaatctaccatgggggagtttaagaccaagttttcaagccaaacggaactggattctactaatttccagactgatgccttggagaggttacttgaatttttctgaatgtccattttctcatatattaaatgaccattataaccttgctctgtaagactgcttgttagatgatataatatctttcaaatatctgttaaagtgcctaataatagcataatagctactcaataagtagccataattgttttaacaaatgaaatttagactcctaggaaaattagaaagtactgcactggctttcctgttttcctaatggccatgattatttatccagtgactcagtgcagattttgatttattttccttttcatagccaccttatcaaaaagtcctgctactgttatttctacttcaaaatgcatctcaaatctattcacctctctctgttcccatctgtatcaccctagtccaagctctcttactccctagagcaatagccggtaaccatgtgcttacaacacattctctgcaaaggcagcagagtgtattttttacagcatatatcagaccataagggcctcttgcttataaaggaccagtggatttttattgcatttactatccaaatctgaagttgccatcataaccagacttctctcattctcttccatgtcttctggtatcacattcctgcactaacctctacaccctgcgtcctcccacctcacctcagcttcaccgtgttctcagtttccagcacgcaccaagctctgtgccacttcgaggcctcacacctgccgatctctctgcctatgattctcttctctatgctctttgctgaaccacctccttcttatccttctgccctcagccttacctcaaccagcccatcattctctcagcctccaccgtagcacttctcatgactggtgcttgcttatttacatgttttctcttgcgcattggccaccacaaaggtaaattcttatctgttgtgtgttcaccttggaatttcccatccttaactcgataggaggctcttattaaatatctttgtaaataaatgatatttttatgatagataattgcagattacatgattgttcagttgttaactctgtgcagtcgtagagtattctggttttaaagattagcacttggtttatatgtgaatgaactttcaaaattagacacgatcttctcagttttcttgtcaaagactgtttctaaagatttgcatgagctagtctggtcctggctatcttcctatcagggatgcattcctgtattggtagattctgtagattaactttctaaatcattcatggcccttccttctgcgccgttaactaggaagtataaagtactttagaacatttcattattagtattcccaatatgaccgtggaaatgtgggcagtgggatgaggcaatcaaactgaggttttctttcatgataactatttttgaaaactacctgcagtgagaaagaattctcaagcaggtgcagtggtgtttgagagaagcataaatggagtggttgagcccagaccttggagtcaaataaacctaggtttgcatctcagctctgttgcttacaagctatgtatttaaactctctgatctccaaagtggttttggtgattcaattagatcattcatacaatgagagtcttaacaaatggtaagcatttttaacttttagaaaaacacaaggcagttagtagacgaagtgtatgaggacattgctagcttaatataaggttctttaagggtaaaataaagagaaagggaagaaaggcagagttctttcttttttaacttcttaaaccttttcttatgaaaagatatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaataagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctgtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgagaaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattgatactatgaaagttctggcctctatctctgaagatattccattgagagatacatgcatgcattcaacatctcgtttttttccattcctgccctttgggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaaacttggaggtagaaaatagaacacaggaataaaaatggaaaagtcctggcagatttctccgtagcagacttcatccttaaaaagcagaattccatccagctcttcttggtggcataattccttatcatggaattataagataaatgctctgtttttatgcgtctctcttttctaaagttgaattgagtgtctgaaagacagatgatgtgtctaataccaccgttgttttacagaagggaaatctaagaaaactatagctaccctcctgggaaaacatatctaggcatttgctaacagtcatttaggctgcatctatgcacttccacacagaaggataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgtagcaataaataatattttatccataatcaaggtggatgacttactggatatcagatattattattaacaaaaagtttactacattgtacaagtatcactagacaaagacaacctctagaaagttaattaaggtaactaaggttctcaactgcaaccacaaaactttcacagttaataataatttcacagttattaacataactttttcaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttcccttattcttcaaacctgatgttagcagggaggtcagatactcaagcatgattagaattgtagaagcttgagcctcatatttaaatgtgtgtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtgtgtctgggaattaagagtatctagttgatttagtagctatatttctcttctttagcctgtttattgggaaatgaaagacaatttaggctatttcattttcagtcagtgtctgttatgaattcattggaaatagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacaaatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgacctactatgtgtaacgcactagagcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctcaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagacggagtctcgctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgacctcaagtgatccgcccaccttggcctcccagagtgctgggattacaggcatgaaccaccgcgctcggccacatgtttttaacttttatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctcctgaccctttcatgagcaaagctggtttcaggggaaactcagggatctgaactgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttaacatagttcacgttgagtgtttgtattcatttgttgtttgtttgtttgtaagtaacaggttttgactaaaattccacggactgtggaacagcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtagatgcgtactttgaggtacaaccacgtgaatgattgtgccaaattattatgacagaaaagtctattgttgatttagaaaaagaattaacactgggcatcatttgaataatgggctttataaagaactgcacatattggttactggtagtaaaattcacagaatgttagatataaaaagtcctaaagggtacaaggaaaacttggtttgtcctaggtcaactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttcgagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgccctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaaggttcttcttttgtgcgttttagcatttttaaatttttacattgatcatgtattgcttttgaaattttaaaaaacctggcaaaatgtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactactcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactccacaaataaattgtaattggccatatagtaaaatatttggtagtgttattcttgtccttttccatatgtacaagagagaaaaataaaacaacttcacatcctcctaagcaagtgatcgagtttagatatttgtcccctccaaatctcatgttgaaatgcgacctcctcatgttggaggtggggcctcactggaggtgattgggtcataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacactttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctataggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctctttttatgtccggcccactctcctgatagatataacctccctcctgtttagttccatgaattgtactccagctgcccaaacctgagaaaaggaattaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaactgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatccctaagagtatttgtggttagtactacatttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactaatactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattatgtgtctgtggtcattcttaaggtcatttttgatgtctacacatttcagcatttgagaagttgtatattacatgcatacaaacccatattcaaatatacaattggctaaacaagtatttgttttaataaagtagtagtaataaaatatttatagcaaaggggacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaaggctaaggaaaaagatgaaagagaagtgtcgcatcccttaccctccttttaaagaaatgctgaagttgctgagcagaaggtgccacagtcatgtcccttaatttatccctcaaccttttccagaagtaaagtgactacacctaagctcagacagtgacagtcgtgggagaaaagctttatagaaacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagatgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctcttgtttggggagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacactgaactgaccattacaagtctagttggcacccatatacatctccttaagccattcttaatctccaaatgtggtcacattctgaggaactggtggttagagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggaacattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaaaggacacagtattgctggcagaagaaatcactcttaaagggaatatagatgctactgtgagagactgatcaactaattaagatcttgttgaagattctcaaattgagtttgagcttgttgacaaaaaccaggcttaggcagagggatgatgatcctgagagcatcctatctccatcaataggagtatgttttcaacctagtggtttttttttttaatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctatgtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactatatcttaaatatattctttatcttttgtcagtcctcaatctggcaagaacattgctgctacctgacctcatagacatgcatttgaactcctacttttagtatctgctctaagatctgatttaagaacagatagtagaatagaataagcttggttctctaggtatcaattttcccaaatttcacagtagttctatgtacagtcacattgtatattataaaatatatgtttaactgtcacatgcaagtatatttcagtttttaaaagctcaaggtgcatgctgatagtcactataaataaataaatacatatgtcaacatctccctatccccaattcctccctcatcaaaaactaaataaagggcaaatgaataaataaataaaaatgtttaaactgctgaccttcctgtcaacaaaggtgatgtgagttacaagaatctgttttctagctggagatgtgggcgcagtcatgagtatgcctccaccattaacagcactaaacccaacgtactcacaaacaacagctgcatgaaaaggccaagcttagtatcatgtgtaatttatgagagcttgttaaaacacatacatgcacacaaagttgaatgaataataccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggttggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtatttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattatacccatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaaatgaggtctcagaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttaagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatcataaaatccagtcttcacgggaccaagctggaacatggctgggtagctggtggggtagtgacagccctgcttcaaggagagatcagaaatgagggatgagactgagtgcaaagtcaaggtcaacacaggctaatcttggcttttggctacttttctgtaaagagtaatgtttctctatttgaaggagtgattttaattcagaagtatattggaaaagtgaaagaattcctagagaaaagttaatcccagacaagatagtgaatgacatatagtttattatccagtgacctttagcacaacaactacacatatgcgcaagcgtaactgctgggctgctctggagttcgccagaaaccccttgcccttagtttgaaggagggaaagaaatatctgtaattattgctctatatcctttgcttttgacataattgattctctggcatttaaaatttatatccactcgcccataggattcttttaactctttcattgtttatttccttgtataagaacaggtctgctagtcagagagaatgttgagtatctttcataatccttgtctttatgggaccaaacatttctgccttgtgctagaaagatttttcagcccagccccaggcaaccaccattcattctactctctgcttctatgagtttgactattttagttacctcacaaatgcttttgctgcatttgttttgtattttaattacaccgtttgatggcaatgctagaaatttaggagctacagctcctctctaacatgaatgctatcttgtcaatgccttcagaagaataaagatcataattctttcttttacattgtgatttctataagaatagtttcctatcttcctggatctagatggaagatattaactttcagactaactgttcactggacaatttttctttcattattcctaaggtctttattgtacatatgatggtgtctccaatagttaaatatgcctctaactacaacatataatttaaactcatacctcacctgggattatattgatgatttttggttcaactatttctcaaatttgagatgctattcagaatttaagtgaggtctaataccataggcagggattagaagtccaggccagaagtctgaagtcatcagcttgggttctgttgatgtgaagtgaattggatcacacagagatagacatggccacagtcaggtgtgatacttgatgtgcctatgctttgcctcttagccagttcttagtcattccatgcaccgtgctccttagtagaagagagaacccttcaggtagacttctgtgaaatcctcacaaggcacagaaatttaatggcatttctgagagtcacaagggttctgtgaagtagaaattatgctctcattacattagcttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataattcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacactttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggggaacgggtgacatattgtttactgtgtttaaaagatgtgttataaatttcacttagtcaaactaacttgatgaaatcaagatagcctatgaggaagaataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactacatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctgcttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttctttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccaggctgctcttgaacttctgaccttgtgatctgcccgcctcaggctcccaaagtgctgggattacaggcgtgaggcgctgcgcctaaccatatttctttatagtaatgcaaatggcctaacacacttatgtaagtgaaatcatgcagcatttgtcgttcttgactgggttatttcctttagtgtgatgtcttccaggcacatccacattgtcgcatataatgaagttttaataactgttctaagacttagctgaagtcaaatggaatgcttctggtacttccctcatagcttatctcctggccttgactatggccatttcctattcccaccctgctctccaaggtggtattctagccatccttcaaggtcctgtgcgaataccatctcctctaggaaggcttcctttggtttcaaggcagagttcaatcgtaccccatctgaaaaccaatgacactttggagtacctcatgatagcccttcacaaacccctttaatgtgactgtgtgtgtatcgtctctctacagtgagaataaaagctccaaagccaggaactatatcttcctcacttcctcattctccacgggaccttgcgtttaataatttaacgaaaattcaacaagtatctgttgatggataaataatcatggaaaataaattccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcactttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggtctcaatctcttgacctcatgatcctcctgcctcggcgtccaaaagtgctgggattacaggcgtgagccactgcgcctggcccaggtcatcacgtttagcctctcagtcctctatgttagaaaacagtaatccaaaaaaaaatgatttctttaatgctagatagtggctgaagtaggactagaactcaagtattttaaagcctgcttcacatttcttgttactaagctgcactgcctcccacacatggcctattttggtctctaaactgtcatgaaaacagatgctaggtccctgtcaaaatgtttgtgtatttctgggtgtgaaaaggtatgtgtgtgtatgtgtgtgtttgtgtctgtgctcatgtgcatggatccctggtggaggggagagaaaggcaatttgtagctgcagacttctgtcattgcacgcagcgcactctgccatggtgagttcatactccacagcaacagaacagctgctgcaaagggttggtgtgctattttcatcttgggtgtgtgttttgcatcaggctcttggcaatggcaagagtaaacctctgtaaagaacaccttcttaaccttttactgttacccacacttagtcaacagaaacaatatgtttaacaggagtttttcctgctggacagttaaatatgcagttcttgcatatgaaacatgaatattttgttcccttctgtggaatagcaataataataacactactagtaataccagctaaaatattttaagtgcttatttcaaacggaaaattttttttttaaatgccagattttttctctctagggcaacagtcatcttgtataactttgaattcacactaaaatcctctgtagcaacataaagatagaaaaatcctcctttcagcaatatggcactgtgtgcaatgagcaaatgcaatgatatagaaggaagattgagtttaagagtatcagcagcaaagtgacagaaacgctcatacattaaaaactaaaaattagacttaattggttataggtgggaggagcctattacttttggtgaggacacatataggtgggaaaaagagaaagaaaaaaagaacatatctatgacaggaagcttcacagatttcattttcataatactttttgagactaaaggaaatagaacattttctgtcatatgtgttccaagtaatgtcattctgtttctcatttgtcttttgacctggctgtataatgtatgtggtgaaacagaactcctttattattaattttttagtggctacattagtaactcttttcctgacaattatgaggaagctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattacagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgacgttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcctacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttcacttccatttcctcttttgtcagatgaaggaattgggccgggcgcggtggctcacacctgtaatcccagaactctgggaggccgaggtgggcggatcacgaggtcaggagatcgagaccatcctggctaacacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcatccaaatcacagtaaaggagctgaaataagattttagttaattggtagccacacatgcccacaggctggtatgccaggctttgtttttctcacactgctgtaccatatccaaggccagagtgaatttcaggtgtcatgggctctacaagggcaagactggagtaggagctaaagtcaagttcccattggagaggattgaccaactgatagaggatggaaacgaagagccaaaggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgtgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccattaaaatacattgacatcccaacacatattttggggtgtcaaaaaagaaatatggcagggtgcagtggctcgtggctgtaatcccagcactctgggaagctgaagcaagaggatcgcttgagcccagttctagactaacctgggcaacatggcaaaaccttgtctctacaaaaaatagaaaaacttagctgggcctggtggtgtgtgcttgtagtaacagctgctcaagaggctgaggcaagaggattgcttgagcccaagagtttaaggctgcagtaaactaagctatgatcatgacactgcattccagcctgggtgacagagcaagaccctgtctcaaaaaaaaaaaaaaaaaagaaaaagaaaaaaaatagaaatagtatatgttgataggaagcttagtgaagaacattaaaaagatttgcttgagctcttggttgccatggcagagctgcgggagctccgggctcagaagatggtggactctataaagaagcctcttgagggagttacatctgggagttgtaatttttcatgttcagcaccagatgttttgaggacaggcaggtgtttatgcagcaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggagtgaggatctttaggcgaagtgacagctggacagttgtgtgaccaagtgttgatcacatgcatgtcaccctgacaatgaccaaggagatgaaggagatgttctcatccactgggatacgtatcttggccagtaaccatcagggctgaggacaggaatctgtttaacaaaaggaaggagaattttagtctttaaggatgtggggaaaagaaagagagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgagaaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaagtcaaaatttcatgtggcaagtgcttctcctggcagcaggaatatccttgtaccaagccagagccttccaaggtacaagttctttttcactatataggaaccgacagactggcagggtcctctaatctggctgtgatctggtggagtttgaggagaggtgtttctgtttggtgtgaggctcctgtttaccagaagtgttgctgcaccattttccataaacaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtacctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatttggttctgatatatacctgtatccaggaataaacagtgaaagaggaaccgttggctacataattatgagagttgtgaagtgctgaatttggaaaaacccggctttcatagaacagaatggaatgaaagcccaaacccagcattgcttacgtagcccctgaattaacagaaccctattgagataataccctgccaacagcaaggtcaaagaagaagaagtaagcgacttggctaggatgagctgtgacttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgaatttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatgtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatctacatgatattaattattgaaatgaatctaaattcttttcacaatgattttggcaagaagcactggcttggagtaaagtcagaaaacatgacacatagcaaacatttatagaccatctttttaattgtccatatgaaaagaataacatctagctgattagatgtattttaggggaatttgggaaagaataaataactctatgccttatgactgtcctgatatctgctatttatatctctgttctgggcaaagaacaccaaaaccgaatgaattaattgttgtgcatgctattatgtcttggatatagtaatatcaacatttatacaaatatcgactcagtacagataaaaaatagaaagtaattttcatcttttgtttttaaagaaggaaaaatattattatagaccctgaaccttcttcttcactgaatgggaggaaataaaagatatagaagcctgaggaatataaaataataagaaggtaatgtgatagaaagtggctgaggctatgtagtttgaatctccagaaaaggcctctctgagaaggagactttgagcttggagatctgagtaacaagaagaagccaaccatgcagggaacagtatttcaggcagagggaatagcaagcacaaatgctcaggtgtgaatgattccagctgtggtagccagagtctatgatgcaagggctaggaggggtggtagtgaaaggagtttgcattgtatttgaacaccaggaggaaaccaacacgtagcattaagcaaaaagtggtatgatatgatttatagtttcaaaagattacaatggttgttctgtaagaagataccagaagaagcaaggagaccagatgtggctattttaaaaatttttcgttgatacataataactatacatatttatgggatacatgtgatattttgatatacacatacaatgtgtaatgatcaaatcacacacttaacatatctgtcacctcaaacattatcatttctttgtgttgggaacatttcagatctgttcttctagctatctggaaatataaaatatattattgttaattatatgtcttaggctgtttgtgttgttataaaattaatttataaagaaaaatatttatttggttcacgtttgtgatgtctggaaaaattcaaaattgggcatctgtatttggtgaaggccacaggccacttcccctcatggaggaaggtatagagagcccgtatgtgcagagattacatggtgagagaggaaacaagaagggaacaggaggaaactagcagaggaagaactcactcttagtttctgcaagaggaattaactcactcccgatctccccactccctgggtaaggcattaatctatttatgaaggtttcacatctatgacccaaacaccttccattaagccccaccttcaacactgggaatcaaatttcaacatgaggtgtatagaggcaaacatccaaactgtagcactatagtcactcgaatgtgctgttgcacactaggacttatttattccttctatctaactgtatgtttttgcacattaaccaaactgtcttcattcctcactccctcatccttccctgccttcagtactatatttctactctttatcttcataagattcacttttcagcttccacatatgaatgagaacatgcaatatttgtgcttttgtgtcaggcttatttcatgtaacataatgacctccaattccatctatgttgctgcaaatgacaggatttcattctttcttgtggctaaataatattctgttgtacacatttaccacattttctttatccatttactcattgatggatatttaggttactttcatatactgttattgtgattagtgcaacaataaacataggtgtgaagttatccctttgatgtgcttttttccttttctttggatcagtccccaaattgagattgctggatcatatggtagttctatttttagttctttgaggagtctccagactgttttccttaatggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccaggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttggaaaaaggtgaaaatgttattaatttaaaatctattatgcttccaattgaagatgaaaagaattgcctagaaaagtctggaactcaaggaagaggtcagggctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaaccaagagggcctgatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgtgcctggcacgcaagttttggttttgtcctttggattctcctgttagatatatgtggctgttaaacaaggtctcagaaataacggcttggtaatggatgattctgacaggatacaagaaatcccagagtgttaagctcatcaggtttattgttagttcttgtttcctggaagtgtttgaagccttgactctattaggtgaaatatgactccattaaattgtctgacattttaatactttaatttagtgccagggaccacttttagtgtaaaatgtttcacagagggttctattttaaactgcctggcttttgtaactctcagttttttcttccaagcctttcaccagtgtaaccatcccaaatttgcatcttgtctgatgctaactgaggaagaagggcacctggagtttgaccagcaggaacaaaacatgttaaaattgttgcagaagatgatgaggtaaaaacacatagcactggggcacaaaaccctggagcctggagcctgttgcaggtgtttagcactgaccttccacataaccatgggtagccataggacctctttaaccctcagttttcacatttgtaaaggcagtgagcaggaattgcattttaaatatacaattgttgtcactggtagcatctatctggggccagtggcacaggagtaaagagaatttacccagacagttgtgaggaaagaaagccatattgattagagaaagcatgaaaatacgttgcaagggtgcaatgggcaaatcagcaagataggagctgactgcaaggagacaaaggcttgctggggattttatgggatggcgcttgtgctggggagggctatgtgctttactgataatgccaaagttgtagtaagctaacttgcagttttctattgtctgagggtctgatagtaagttgggcatgagaagattgttagtaatttgcacagaagggctatgtgtcctggaccatgaagaaaggcagacttgtagcttatctgctttttctttttggtttctcctgctcccaacaacctgactccttttctctaattaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagcagaactgataaaaagcatgaagttgtactgagagatttttcaactgtacatagttgcagaaagaaacaacctgctaccatagtaaatatttgtgttagaactcagtggatgaaggtggaggggggaacatggactggaggggctaacagagtatatgtagtaggcaagtgggattggagtacaagggaaggatagctgggggtgacgaggttgagtctgtgaatgagaagggcttaggtcaatttctctttctacccttcttccagctcttctcctccctctttattcctcccctcttccccttccccctcttttcctccttccctctgcctcctctcttcttcctcctttctgcctttactttatcctttaaagtcttaaaaaacaaaacaaaacaaaacaaaacaaaaactgtgatgatagaacccaaagtgtactgagagatttcttaactgtgggcaggattgttaagtggtagtaaactcaagacaacatttatattgcactttacaatacataaagcactttcacgtaattaactcctttgatttgatcatcacaacaatgcctgaggctaatagttataaaccttgttactgatgaagaagctgaaattcttatcagttaaatgtgttgctttgggcttagtaattggcagagcaagccaagtctgtctccagaccccgtggtcttctggttccaaattccatgctcttctcattatacagcacaatactttttttttttataaaatgggaaagtctttttttttaatgtatttacagacagttcatggctttagacacacacacaataaagccatttttattaaatataagaaagtggagcaaatttgcgtccttttttattttctaatgacaatgctaaaagctaaaaggcaattggccattgacgggagaacaaaggaacctgaataattgataaaatgtattctaaatccagaaactgtcaaagtaggcgatgtcagagatgctgcagttgcttggttgttcgtgatatctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatattgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggatgtaagtgattctgagcccctctccagactcacactttccccaggtttcagtacctggggctcacaatctcagtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactctaaagattttcccttatagttatagaaattaggaaatgccctattgtgcatctttccttcccaactgtaccgagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcctttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcgacctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccactgatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccctgttaggggcacctgacccatcaggaaggccattgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacaatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggttcagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagacctaagtctcaggagagatgcaccgaggctgctgcagagctgtagagaggagatgaggagcgagcaaaggaggtagggttggaggcgcagggcatctcccaccctgacttgtctcagacatgcccctcctttatctgttgattataccaggcttacagggaggattttatccaaagaattcacctgctaaaagaggaaaacattttaaaattactgttgtagtccaaatagtctctggaactagacgattctggattccaaatatagacatgtggtgcttaacgacagggatactttgataaatgcattattagactattttgtacttgtgtgaacatcacagagtgcacttacatgaaccctgatggcaaaacatactacagacatactacatactaggcttatgtggtctagcctcttactcctaggctacaaatctgtacggcatgttactgtacttaatactgtaggcaattgttaatacagtggtatttgtttatctaaactatcaaaacctagaaaaggcacagtaaaatatggtataaaagattttatttaaagtacacctatataaggcacttcccatgaatggagcttgcaggactgcgtgttgctctgggtgggtcagtgagtgagtggtgagagagtgtgaaggcctaagacattactgtacactactgtagactttataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctacaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgccttcttctggaattcctcctgaaggacctgcctgaggctgtttcacagttaactttttttttttttaataaaaaatacatgtagaagcagtacactctaaaataacaataaaagtgcagtatagtaaatacataagcgaataacagtttttctaatcattatcaggtaatatgtactccatataattgcatgtgctagactcatacaagtggtagtgcagtaggtatgtttacgctagcatcaccgcagacacatgagtaatactgtgacattatgagggctatgatgtcactaagtgatagaaattttttagctctgttataaccttataggtccacatcatataggcaatccatcagtgaccaaaatgtcattatgtagagcatgactgtattagttcgttttcacgctgctgataaagatatacctgacactgggcaatttacaaaagaaagaggcttaatggactcacagttccgcatggctagagaggcctcacaatcatggcagaaggtggaaggcacctctcacatggcagcagacaagagaagagaacttgtgcagggaaactcccctttatgaaaccatcagatctcgtgagacttactcactatcacaagaatagcatggcaaagacccgccaccatgattcaattacctcccaccaggtgtctcccacaacacatgggaattgtgggagctacaattcaagatgagatttgggtggggacacagctaaaccatatcagtgactacagtactatagcagttgaatagttttttttaaatcccttgagtatcttatgatctataaaatggcagtcaagcctatcctgtggatatttgcaaggcttataaatattgtctggaagagaaagatgacttaggagtatattataactcttgatgtttttattatatttgtcattaatgtgcacaaattataaatgtattatcattaataataatttatttaaaaaagtgatgggatatcataaaacccttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagaaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatcatgctggtcaaaattttctttttatagcatccagacagcttgtgcatataactacatgcagttttattttgtggccaactggcaaccatatggaagtcagttaaaatgtattttgattatatgactctgtgcacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtcctgccttcttcagatgtgagagttgatgttacagagatctctttggtaatatgactattttaataaaatattcacaattaaaaatatatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagccgcagtggctcacgcctgtaatcccagtactttgcccgagatgggcagatcatgaggtcaggagttcaagaccagcctgaccaacatggtgaaaccctgtctctactaaaaatacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctgaaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaacccagcaaaactcctagagaattttcatggggaaaataagcatattgacattctttgacttttgtaaattgattttttggctccagctgctctaaagccattaagagttagagttaatcattcttgatttttttattgttagtcagttcccttattcataacactgaataatagcaatactactgagttttatttgtgttcacattcagtgctatgttaaaaaattcacaaagtaacatactgaaattcttgcaggtaactggtaaaatatgtagtctttagtagactgttgattgatattctagtaaaagagtaaatcttgtgaatttcagaggtggtcccaagatggtcttaaccctactgtgttaaaaaatatcagcatctttttcctataaagacaacctgaaggctcttttgaaatatgtataagtgcttctttttaaaaaacttattgatcaaatcagcttaattagctatgaaaggaatgatccttcacccctatgttaatgtctgtttacactgtgagtttgtaaaagcttctgatagagattgatgccatatctaataaattatcccactatatattcataaagtactatgattatatctatatgaatatatatataggtgaatgtagattcatatcaaaaattgaaacccagagaaaaaacttggaatttggtaggcagaaccatgaccctcctcaaagaagtcctcaccctcatccccgaaacctgtcagtatgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagaggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaaaccatattattactaatcagttgaccttaaaatagataatcctggatgatctcggtgggccccttgtaattacaagtttccttaaaagtggaagagggtgacacaagagaagtgagagtgacgtaatgcgaacaggactcaacacaccattgctgactttgaagaaggaggcctgaatttcaatagccacggaaggggacaacctttagaagctggaaatggcaaataatactacccaaaagccctcagaaaggagttcaaccctgacagtacctttattttagctctgtgcaacctgtttcagactgctgcagaaccgtaagataataaattcatgttgttttaaggcactacatttgtaataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataatagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctgagcagattaatttgagagtccaggaaaagcttattaaacagattatgagaactagacaagacttttgagaccatctgtccaaaactttggttttaccagtaagcaaattcagacccagcatcactcagctggtaggtggtaaaactgagaagagaatccatgtattttgttttttcctagttctgtgttgttgcactgcataatgaattccagccagaaccacacattcagttcctgactagtccacaattagaatcaccatcaagtcaaacacaagtgaggcattacatccaggaggtcatagttagttgtgtgtgtgttccctagatagattccctgaagctttctcatcaacaccaagaagctgaaggggaaaatgaaagttccccttcagttcccctcaattcaagagtaattgagaccaacatcattcatggatattaataatatgaccttttttaaagaatcaccaaatcattacatcataaagaacaatgatcttatattttactaggtttattagttgcagtctcagcctctaggttgctagaaagctctgggctcctttggatatggacatggccaaatctctttaactttctagttatggcactttaggcaaattcaacttctctgagtctaggttttctcctctgttcaatggaactgacaattctatgtcagagagctattgtaaggattaaaggaactaatatttgcaaaccccatactgttgcttggaataaaacaggtgctgaataaatggtagctatttgattgttagttttaaaaaatcttgctagaaatcattaagagtgtatttatctaagtgggggaaaagaaaaacctaagtaagacccttggatcttgaaagaaagaaaaagagagaaatgattgtcaacacaaacagaaatgcttgaggaacttcaagggctcaagagtcaaaggacaggctagaaaaaaatgtcagagaagaaagagctaagagaagaaagtcaaaggaaaggagagaaggggagaatggaaggagaactgagaaaccagcagtgtttttttaaaggtgataactgaagaaggtgagcagaggaagaaagaacacagtgagtaattgaaatcaccagttattttcttctgattcatctcttaaaggaaataccttctaagagagatctttgctcttttgtgtgctggtgaatgtaaggtgagaatctctcctttctttttctaatgatgaccctgaacaaggccgtgctcttcttttaaacatctcttctgtttgaagctctgttacaatagaatcaaatagggtctccttggtttatgtcactgatctaaggttgaatgatgtacttgacagatccttttgaactgccccatctgggaactgaaccaaagactggatcgccagtcatggtactcacaattacctttccctttccgcacagtccccacattcactacccgaaagtataaaatccatctcataagatgcagatgaagtagaatgatgcggtttcccaaacttgcctgattatacaaaagcccagaagcattgctgtctggagattcggattcttacctcaaggtgattcttatcattagaaagtgaaaggtacagaaatgaagaaactttcgagtaagcaacgtttcctaccaagggactgggtggttctgaatataacaccatctttctcctaacaatagaaggtgacattttgacaaataagcttaggattcgtattcttccctaaggtatcattttgctgagctatcattttttttctttctttttatttttgagacagagtctcactctgtcacccaggctggagtgccgcggtgtgctcttggctcactgcaacctctgcctcccgggttcaagcaattttcgttcctcagcttccagagttgctgggattacaggggcccgccagagtttctggctaatttttgtatttttagtagagacggggtttcactatgttggccaggctggtctcaaactcctgacctcaagtgatgagcttaccttggcctcccaaagtgctgggattacaggcatgagccactgctcccggacttgctgtaagctatctttttgccactcatgatgatgattgtatggatgactctctggtctgtgttgtcagtattcaagtggtacctccactctgtcacatcttcattttgcttgtctagcagacttgctagtcccttctgtcttgttccatgtcaggcttggacatatgaattgcaatcacattgtgagacaattaattgtccaatatttctcaagactccctgtcctttagaaactattttgcattcatctttgagtcctcagtattttgcctagtaaacagggtttgtcaagtgaatatccaatatagactcaggaagatccacatggggagtgagaaaattgagcgaatcccaggaaaagaacaggaaatggaggtaaaagactcacgtaagtttacccttctatccaggcatgcctccagacaccagcttccacttccttatctgtctggaattggtgttgaattgatcttcgaggtcagtttgaggtttcttactctctatatgagtctctgatacttagaatgttattttgtgctcagattgccagaaatcatgaagaaatgaaaggggaaaaatggtggcaataatgatgactaacaatgttttattgtgtgacatgaagttaaacagtaataatttattgttatattgaatgctgcagcattaaactgctgcctccagtgttaaaagcaatgctcacaagacagatcttatgagaaactctatgtaacagcaaaggatcactgaaatattcagatacagaatttacaatagttgcattagggcttcctttgaattaattaatatttcctctgagatgactcctgccaagtggttttgcttcattcctgatttaattgctaggaaaatcagaattattccagaaagtgaggctatgaaggtttcattgtaggaaaatcttgtgtctgaagccgtgaggctggacaaagggaaatgagttgaatgctgttgtgaatgggcagaagtcagcaccagcaacttccattcatttcgaagtaagagttgataagagaattgactgttgaagtcaaatctccgtatattttcttatttccttctttgcatccatcttgcaaagcaaatttttaagagaaaacgagtgtttcattcttgatagtgaattgctctgcttcttcagcaggaggtgcaggagaaatcctatttgcatcctttccactgctcttaacaagcccctaaaggctgagttaatgtttatttgtggcctggagtggccaaaagggaatagcaggaattattttcttcatagaagtggtggagaatatgagtgcctccctctataaactggagaagatttacctgcacaattctcctctctgctttttagtactgcttgggggatgaaagggacccatggactttggcctcagacacaccaggctggtttcaaattttccttttttctgaaatccacagtaagccacttaaactctctaagccacagtattctgttctgtacaattggaataacaatgctgtgtactggaacagcttcataatttgtaggcccagtactaaatgaaaattgggacccttttgttcaaagaacatgaacttcaagacagtaatggcagagcatcaaataggtgtgtggcccttctgagcatgggggctgtaccactgggcaggccacataccacgaagttgacctcactgtgcagctggattggctgttggatgtcagatatctttccctttgtatctctgtatctcagagagtggatccctgaaaatggcatttgcactggctgctagctagatttagccatggaaggcagtagtaggagactgatggtgagaggcacggggaagccaagttatttccctcttttctcctttcccctgtctctatttccctttgaaacgtatctccaatagtaactgctctcctctttcagttccagcatacctaggacagcccaccttctggggtcccacctttcctgatcccactcactgctagtcagttctctgcaggcagcccagctcctcatgctctaaaaccaccatttccttggttcctccagcctgacaggtgctagctgcttcctgatataactaatatcttgactacctccctgttccctatgaggcatttcagctcttccaagcctctttaactagttccccttattaactattctttattcttcatagaatctgatataagtgtctaccttgaaaggttattacaaggaacaaatttgtctaaggcagtggttttaactgtacattgcaattcatttgtgagtaatacaatcagtttgatgggtcaagaccggtagtttagaacacaaaataacttagagcagaataagaaaacatggtagtgcattgtatgtattaaggtacatatgatttaataaagcttttagttgtctctgtgtgtatgtgtgatgtgtaccatttcatgctgtaaaaatgtattactttctagcaggtgggagaaggaaagaaaggccaatggtctaagacttctggtacataattagcactcaataaattgtagaaactattgttgccatccaagaccatgccatttaaacaaaaggcagtcagacagcccaaagagtttaccattccaactcactttagctcattagaatagtttcatgtagttgggccaacttgtactaaaatggccaaagcgtttacttacatttgtttgtttacacctagacaggcccagcttgagtcaccagccttggctgaaagagaagccagccaggttcaaagtaaagaaacagttttaaaataacattttatttttctgtgagtcatagcaaatctgtccctgcaacatctttctcctgcagctaaatgctttaaaatggtcaggtctcacccaggaaagtgggactgggaggaagtgatgcgataaaacagcttcccaatcagtgcattagtaggagtgcaacctctggcattcctcttttttcagaagtatcaaaaagctctgcagagataactgtgtctccagatggccatgagattggtaaatgacaaatgtttatcagcctttcagcacctgctgatggaagaactaaaaaaaaaatcgcaagtgactttatgagcccacagccaccccagctgtaatgggtgctagtagctctgtgttgctgacctcacatgggtaaaggaagagcagaagaatttttagtcccttggctacttcttatctatttcatcaggtaaggaaactcaacttgaatcctttcaactctgaagaatggtagatctgaggaacaacaaagagctataggtcatgtggatttctctgctcagtcagagagcccagaactctccctggagctgaagatagcccttgcaagctatctcatgatggttttatagcacagtgggctcactcatactggtgctggttttgagcatctatgttgacaagacaaatgtctgtttctactactgcagaggatagagtttaaccaaagtcaggtgacagagaaaaagaacagaaactgataacacttacacagtatccttatatagcaggctcttgaataatgcaggcattggggtgacaaccacccttacagtcaaaaatctgtttataacttttttttttttcagatggagtcttgctctgttgcccaggctggagtgcagtggcatgatcttcgctcactgcaacctttgcctcccgggttaaagagattctcctgcctcagcctcccaagtagctggaattacaggcatataccaccatgcctggctaaattttgtatttttagcagagatggagtttcatcacgttggccaggctgatctcaaactcctgacttcaggtgatccacccgcctcagcctccccagctgtgtagataacttttgacgccccacagccttaactattaatagcctatcattgactagaaatcttactgataacagtcttttaatgcatatgttatatatatacattacactatattattacaataaagttggaaaataaaatgttattaagaaaatcacaaaaaaagagaaaatatatttactattcattaagaagtggaaattgatcatcataaagtcttcctcgttgtcattgtcttcaggttgagtagctgaggaggaggaggaagggaatgggttagtcttgctgtctcaaggatggcaaaggcagaaggaaatccgcatgtaagtggacccacgcagttcaaacctgtgttgttcaagggtactttatgttgtccgggatgctatattgagtactttatacatataaatttacttaatcctcacaacatgcctacaaggtggatactactattgtcctcatttccagctgagaaaacagatagagaaggcaaataatgtgctcaaatctgcacagttaattaatcatagagcccaaattcaaacaaaatagtgtggctgccaagtcaatgctcttgacctctacccagactgggagccagagggtttgcattctaattttatcattaaccaatctgactgatggggcaaatcaaccctactgcaatctcctcttttcatctgtaatataaggttattgcttgagatattttcaagtcttagtgccacctcccatttagagctttagtgttgagaaagatgatattaatgtattccgttgtcctaaatatttcaaacacgtcagtttctacttttccagacaactccaatggggatatttttttattcctccacttcctaattaaggctgaaagggccccatattcagctgctgagtctctgtctcccgccttcttttcctcctgtacgacctaaaactgtcttttgtctttcagcacttggggagaaactctgggaagctttctaaatccctaaatttgtcacacccatccttaaagcagtgctgaattaaaaagtgggattcgtctaagcagaggagatacttaaggaaggagaggggctacagcactaaatgatgtttccaattaagagaagtgtaaggtcagagagaaactccctcctggatggagctcttcaccacctgatgagctgattaaatatcatgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaagtaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcctgtaatctcaacccttgagaagccgaggtaggatgattgttagagcccaggagtttgaaaccaaccaatatagagaccctgtctctacaaaaaaaaaaaaaaaaaaaaaaaagtcaggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaataacctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattatttccaaatatatacttattatttcatcagcttagaatggtttggatagaaaaatatatcaaggtctcagaaatgccccccattaacataagggtagccatgacttgaacccaccccactggtttcctttgtctttctccatttctgattctctttctctgtggttacctaggatatataaattacttgactttgaaattcatgattaactcagaaagttatagctagtgattcacaatatttgttttaaaaacagtatgaagaatgtagaagcttggtttttaattataataatataaattagtatcattttatgtactcaaatgccacacacatatgtataaggcattcctatggaataatcttaacctggttctttgacaatttttgtaattcattctctagtgaaatatttccccaaagtgtatccacagattactatctcaccaatatgcttccggaaaaaaagtgccatggtctaataagtttaggaaaccttgcacattctttttccttgggatcaatcattagtattagcagatttagcactaagaaatcctgtagtagagaaattcatttacttttaattcagtatttctcaaaatcattttaccctattactcaaatccctgcttttattctgggaattgttacctctcctttcctttgcatacacttgagaaattgactctagaaatactagccttatgaaatattgatagtaattgctatggtttgttagactcctccaaatctcttgttgaactttgatccctagcattggaggtgggcttaatgggaggtgtttgggtcatgagggcagatccttcatgaatacattaatgccctccctggggtgggtaggaactgagtgacttgttgctctattagtttctgtgagagttgtcccccgactcgccgcagagctggttgttaaaaagagcctggttcctcttccccctctctctcttgcttcctctctctccatgtgatctctgcacacaccagctccccttcaccttctaccatgagtgcaaacagcctgaggccctcacagatgcagatgccagatcattgcttcttacacattgtgtagaaccatgagccaaataaacgtcttttctttataagtaactgagcctcaggtattcttttatagcaatacaaatggacgaagacagtactgattatttgttgggcatttcctatgtgcgaggaactgttacaggtattttggcagttgtaatagcgaggtatttattttggtgctttaacagagactaaaatggctgctttaaataagattgattatttctctctcacatgaaagcctaaaatggtgagcagtgtagcaacttagggcagcaatctttgggtcatccaaggcatcagataccttctgtggtgttgtttcaccgtcctttgaagtgttcctttcttcataggttgaaaccagctccttgtacctcatctggtcccatccctaagaaaagagaccaaagagccatccttgagaaaagagaccaaagagacatccctgagaaaagagaaaataaagggcaaacagcttcttgttaagaatctggtctggattatgctcatagctcattgtccaactgaataaattgctcaatttattgagctcataaattgctcaatatgacatggccatacccagcttacaaggaagtccaagaaatagtctcttattggggaacatttgctctcctgaaacatagaaggttctattatttaataggtagaaggaaagaatgagtattacaaggcaattagctttctctgctgtgtttttacctcattaaatcctacctacaacccatgaaatcagtactttgtcttcattttaatatgagaaaactaagatacagagaaagtaaaactaaagtcacgtagcgactattcgcttttggttttgataccatgctacctaattccatagcctgggttcttagctgatacacacagttgcaatgcctttccagaaaatttctagtagtttccaccattcctggacctattcttttctaactttaaaggcaatccatcttctaagtcagtgtggcagagactctagtttcttcacccaaaccatgttctcctgtctttcttgggctcatgtttaaactatatttctcatcttctcttaggtattaccatatgactaaggtctagtaaatgcaatgtgagaagatctgttgtataccacctccaggcttggcctgtaaaaacttcccatggacatgagctcctccatgccctttcccctccagctagatgaattggaaatgacacccaggacaactggaaggccatatgtcaaaatggacaaggcttgctcaccctgaattctagaataattttgtggaggagaactaccctaacaatctgttttcccacctagcaaaaaaaaatgtgaccacaaaaataaacttctgctgtgtttgatccatttgaaagtttttgatctattagttctagcagttagcttcctctaaaaaatacaattgattaccatgatgtcatggataacaagttggcaacctgggtcaaagtcctattcttgtttttttctagtgataagaccttgggcaatttattaaatctctccaagtctcagttttctcagctttaaaataatcttcaatcatagtgttgttctaagaagtaaattagtttatcttaaaaatcctattccctgttaattattccattctagcaatcaatttgtgcttattctagttgtcccactgtttaaaacacacatgccttagtattatgaaaacatttcaaaagaaatatgtcttagatttctacatttatattagaaaactttcaaatttatacttcatgccttttaaaaaaataatactagtaaaatgaaagaatatcagttttggaatcattccacagtcctggataaaaatacctgttagaccacttactagtggtatcatctatgtgagactcaaattcagcatcagtaattttggaagaatggtagtcctactttcagaattgttaggattaaataaagtgctaaaagtctgtgaaatctccttgcacactgatgatttcccttctctccccaaatagatttccatatggagcacttttagtcatttttgctggactgcaatcacctttctttcttcaaatgttaaaactgaacagtagtagctagcaatttggaatctctagaaagaagttttttttattattatagtgctgaagctcagctcattctctcaaggagcctatggatttggagtgcatcataagggaagaagttaacctcctgctgtattaccagagaccaaggacaaatgttggttgtcacctgcctaaccaggcaagtgatagtcacagactgtccatctcacaacaaaacaatgctaattttgttgagggatagaaatgttgtagttgatctcattttctctagcacagtgtccctttttgaatgttccttctcaaatagggcatggtataaactctgcaagaggggagttccatttggaagacatgtaggcaaacaacattcaggctccacacccacttcgcctgctgagatttgacttattacacaactgcagatgctggtcaattagtttctcatactcattcgtatcacagaagggatgcagtggttataaattgcactgattatgcacaccttggcttaccctattgttgcataaaaataggcaaggcatgttagtcattgcatagtcttttcagtagaaaggaaaagtgattgagaaacagcaaggaaaattgtgtttacagctaaggtttttgttttgttttgttttgtttccactccgttcagtgtgtatataaagttaatgcatttttaacttaacagcaaccaacaacagcttcactttgagtgcatgaaaaacactggggcttaagtgttgatttgttgccaggcatttcctttgggaatccatgtaggctgatcatttacctgggaaatcgtgtgtgtgtgtgtgtgtgtgtgtgttacctttacctttgtaagggacatcataaaacctcaatttcctggtgtgttccagttaattttctgctttattgaatgtcactctgaattccctatttcctttaacttttgtgttgaaaaatcattcaaaagactactgagccattttcttcttcattaagaaaaatattgggttagacttaattcttgatagctgaaaattttggagcattgttttgtttgtttgttttacatttttgaaacaaactattttgagaccgtaataagaacaatggataatcttcccagaaatcagagagagaaagagagagaattctgcataaatttatagatccttgcagcccacatttgaggccccagcaatagaccccaggttaagaattcctgccatagagtgttttgacattatcattctaaatatttaattttgtccaaataaaaatatagacagagaaaagggaacttagcaaaaatcttcatttacattcaaaacaattcaaggtgcattaaaatcatgaaaaactttgttcctctataggccagggaagtttcttgctacttatttcctttattaaagtatattttattgatttgtctttttcttttaaaaacagaatatccaatgggtaagactgaccaaagatttggggaagttgattctaaataggtgagctgtgttttaagagttcttcttagtactcttcaactcagcatgtggaaataaatttcaaaagcttttcttaatttcacaaaaacaaatataaatagttatggggggaaataaacaacaggccaaataccagatggcaactcaaagcacattgtctgctctcttgctctaagctactggttctcagtaggggtgggacagctcccaaaagggggtctttgggaatttgtggtgggtttttggtagtcacaatgttaagaggtactataatagctatttagatggcagagttaggatttcctgtttctttttctttttggtatccctcatgactatatagtctccccaatatattcacatgggtgaaaatcctattcgtaatgattgaactcaattataactccatttacagataaacatgcacaaaattttcatggttttaatacactgaattttccaagggtgtgtgaaattgctgtacatattgacagaagattgttgtttgatttggttaagaactttttattattattattattattattatactttaagttttagggtacatgtgcacaatgtgcaggttacttacatatgtatacatgtgccatgctggtgtgctgcacccattaactcgtcatttagcattaggtatatctcccaatgctatccctccccgctccccccaccccacaacagtccccagagtgtgatgttccccttcctgtgtccatgtgttctcattgttcaattcccacctgtgagtgagaacacacggtgtttggttttttgtctttgcgatagtttactgagaatgatgatttccattttcatccatgtccctacaaaggacataaggaaatgtggcacatatacaccatggaatactatgcagccgtaaaaaatgaagaacttttttaagagttatttttcactttagaaaatcagctagagaccacaatgctgtttatggtattgaagtccccatgagaatgcacctggatcagtgtacatttgtaatgatcagattcacagtgattccatgtgtaggtataagcttttctctacttcaccatgtgtccttgtatagttattgataggggttggctgtggccccctcccaaatctcatcttgaactgtagctctcataattcccatttgtcatgggagggacccaatgggaagtaattgaatcatgggagcaggtctttcccctgctgttctcatgatagtaagtctcatgagatctgatgattttataaaggggagttcccctacacaagttctctcttgcctgccaccatgtaagatgtgactttgctcctcatttgccttctgccatgaatttgaggcctccccagccatgtagaactgtgagtcaattaaacctctttcctttataaattacccagtcttgggtatgtcttcattagcagcgtgagaacagactataacagttatcctgcatcttaacatatttcaatattatttattatatacttatatataataatataaaaatattcattgtgcatttatatatcataatatatatattatgtaatttttcattctgtcttataatttattctaaaaattatatttttaagttaatttataacttattaagtcagtgtttctttaggaaatgtgccctccgtcaaaattttattctttttggtctctttgctagtatgctactagctaaagaaaattcattcccactaattctggattcttatagttattcacagccatgctgttaaagagacaagtgaattactaccttctcagagttgaactcaagggggaagtttgactattggctggcaaaataaagtagtggaaatttatttcttttgttctcaataaaataacctgtgaaccatcctaaaactaaaaaaaggaaattatttatgaagagaagttgtatcatttaaattcgttttctctcttttccctttatttcagaaaccttccataataaaaacttggatataatgaaattttgcataaatgacatgtgacaacctaatttagtggaagccagggaacctgctaatactttaacttcaaagctcttccattttattccttcattacttttcctcctttcaaagcattctttagccatgcaccaagttcgaacaatgacgaatcaaatcctcagagccaagaacaatgttctaatatttccatgcaattaattgctacttcttggtgagcatccagtatacttgattctctcatagaagattctccaagcctgacactcggttgaagtctgaggacttcactgaggacaaagagggatcaaatcttcccaacaaacagtgaactcaccatgcaaagtgaatagaatcccctaatcaataaatcactaaatatttatggagccccgaaatcatattgtgacaagatttttcaaaaaaaaatgtagaaactaagttatgatacaatcacatgtcaggaaggtatattggagtactacttgtccaggactccactgacacccccttgtgctccctatgtcattttgatgtaccaggccattcactgtatctataacgtgaatttttgcccctattttcaatgtcccccatcctattagcttttcctttccagtaaacttctccaaacccttcctcagtgtttcaaaggcaacaaaagttatcacaacaaaagtaactagtatttcttgagtgttcacagtgggctggacaagcaaagtgctttacctgcattgcctcagttaattctcttaataacctatgacatcagctctattattaacctcattatacacatgggaaaatagacactactatgggctgaatatgccccctccaaaattatgttgaaactaaatccccattttgcagtattaagaggcagggcctttttgagtggccagccttcatgagtggattagggccttatgaaggggctggagaaaactaacttaggccctttttgcctttctatcttccaacatgtgaggacatagcatttgcaccttctaccatgtgagaacacagcaagaaggccctcaccagacaccaaatgtgctggtgccttgatctttgacttcttagtctcagaactgtgagaagtaaatgtatattatttgtagttacccagtctatggtattgtgttatagcaacatgaagccagacagaaaaatttacagttttcatcacttggcagaggtcacataacaggtcgatttgattctcaagccgtctttactattatgcttacttggcttttatctctgtagactttaattgctgagttatctttccctgagtcattgctgcttcaaatctcagtctttaggaatcacttctgtaatctgctgattaattatgcatagatcataaaagttatttaatccagctgctgtccagagtcaatatcactatcctactcaaaaatctgcaacaatctaccacgaaaaatcaattctaaactccttagtctgacattaaacagcctgataatctgatccaatccagcctctctgcttctacctatcttgtttacctgtttgttgattcttattcaattgcttccttgatggaggactttcccacccactccatcactacctcttgtttctgcctgcacacatcatttccccaagtcttttgataagaaagatctcctttttacaactatttctctgctctctcctctccaacatatcttcctgacatgtgattgtatcataacttagtttctacatttttttgaaaaaccttgtcacaatatgattttggggctccataaatattttgtgatttattgagtaggggattctattcagtttgcatgtggagttcactgtttgttgggaagatgtgatccctcttttctctatgcttccatcatgacctggatatacttctagtatggccctttctaattcttcacatgcatgccttcactggactgcagactccaagacaggggccatgcagtattcatctttgtgtctttccagttactccacaacaatttattgagtgaataaagaaaatgctgagaaacgaactcaagaggttttgtagatttaataccattgctctgggtatcgcaaaagataatggctattaatgaattagtaccccacttcccaccacctcaccctgttgacatagtatgatagaatgtgtaaccacttaatctaccttaagatgctattgggcaacaacaatgtcttgactttaggggctggaaagcaaatagtatataatgtccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccagggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagatgtttagcttttcaattttctctctgccaaatacaaattagtgtatttccaacatcccagagtcttagctgtgcattgccagcttccactgcttctccttaattaacaaacagctgtagaagagcttctcaactgacatggggggaagagctctaaggaagatatggactatgtctcatatcttcaaatcctccacagtcatctcctgttagatcaccaagaagaaatgcccagtggagacacttcagttcaatgaaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctaggctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccatgaacctgaggaggaaagaaaatactcacaaatagtttagcccctttcataaattgttggtccttaatccatttttgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacgtgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataactagccactgtactctagcctgagcaacatagttagaccccatttcttaaaaacaaaacaaaaacatccttctcctcttctcctcccccagcaattctggatggctcatctaataaagtacatatattttacctaatctagtcaaatgtaatgacacaataagattattattattctccaatccctgctctgcaacatatttggctgaacatttttggctgcaacatttttggctgaagagaatgaggtttcttcctccctgaacctgggaactaacatgaggtgttttcttccacttggtggagctgtgcacatgtgtgcttgcggagaaaaagaagagtcccagcaggccctctactccagctgttggagattgagctttccagtgcattatcctggctttatgcagtgatgccttccccctgatggcagtaaaattttaattagagggcaatgtgcattcctatataatggagtgcacacatggcaggaagttaacaggacacgtttgcagttccagtttcattgtcaaccagctgtgtgattcctggcaatttgctttattttgttgtgtcacagttcttgactaggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaagcttcccccattcctttctaggctaactcctactcatcctccaaatttcagcacaaagtcacttacagtgggaatgcttccatggccctctattagcagcctctgatttatgctcccacaatagtcggttctgcctctggaccatgttttatcctattgtttttcctccataagagcacagtcataatctgtataactcagtgttgtaactctggcagctagcacaatctcaggttcataaaaagagctcaagaaatatttgttgaatgaccaattagatggcatattcatttcctagggctcctataactaacgctagcgtggtgccttagaacaacagaaatttatcctgtcgtacttctagagggtgggggtctgaaatcaaggtgttgtcagggctgtgcttcctctcagattctacacagaatcttcccttgcttctttggtggcgatcagtcctttgcatgctgtggcttgctgctacatcactctaatctctgcctttgttgtcatatagcattcctcctgcatgtctctctttgcacatggcattttcctcttataaggaaaccaatcacattggattagagcctatcctaatggcctcatcttaacttgattacatctgcaaagactctatttccaaataacgctacattcacagatactggaggttaggactttaacatatcttttggaggaggatacaggtcaataacagattgctaaaccaattaactaattactaattaatataaattatgggtggaaaaagcttccccagatcacgataaaaagctgtgtcgatctaatcaacgtgcttgcttaaataaggcatgtgtataatatatatgcatgcatctgtgtatatatacatatgtacacatgcattaattatgttgtgcaaaaaccccaaaggctatttatcccaaatagaaaatattgtgtcgtttgtctaaagcactttaaagacatctgcctttttcatatgtaaatttcttggatgacaagaaattactgctttgctagcttttaaaacactaaattatgataatccatcaccaaataaactataagcttctatcatttaaaaaatgtaagaactctgaggttagtagtagtttttagttgccattgaaagacggcagtttaacgtcatcgtttattcagatttccaaattaaggagatctctgtggttagacattcctttcgttatcactctccttttcttcaggcctgtcatttgtccattgatgtcttttccttccaaatgattcatgtacacattaggtcttttccctaagcctcatattatgaaaagcaaagctacatgaaaaaaagcaaatgattgctaaattatgtcctaatttctagcattcagcagtgctaaaatgaagcagagaatttcacaaaattctcagataaagtatatttttaccaactaacattgggtaaaagggactgagatagagatttatttttattattattaataactttgaaaatggtgcatttgggaaactacttactaatgttcattggaattggtggtaatactgaggtcaggatttaattccaggcattacccaaaaagtccatgtttgccttgtttcaagcctagagttcttaaaacaatccctgcaaggaaccaggcataaattatctttcagattggtgggcgtaggaatctatactgcgagctaactgtgctgaaatagacattttagaggatgtgaatgtctatctcagacaaaggagattacaggttattaaccaaggcacttttcaaatgccatccctttgggctttcttacttagagtttcagattcatttagccaaataccagccttatcccttccctaattttcctaaatatttgtggctgaatatacttttagctttaggagtgcagaagactttgagggaaagaaggcagggttgaaaaaggatgagtttcaggtcattacattgcttcaaggcagtttgcagcttgcattcatatttttaaagtctaaattagagccctttaacaccaactatcttgggcacacatgtatgtagaagcataccaccatatggcaaaaggcagagttgctaaaactataaataacaaagaggaaggttaattagcaaattaattagctgaattctatacaaggtactaacaataccttaatttccagatacatttgttatcaaaaatgtctaccttaataaagctgtggggacttactaagtgtatttgctgggcatggttcccagttatgaaatattaataccttgaaaaataaaacatgcttatgaaaatgcagttatgctctcattttcagaggaatatgtaagtgaggaataatatagaaatcctaaaacaactggaaattcagactaaaatgaagtagactgtagttttgtcattgcatgttctgctcatactaaagcacctatcctcccactttaccttctttaaactgcagggcagagagttatatttttcatcttcatgttgagtagagaatccatgaaaatctaatacccagttatcactcaagtgtgacaaatagaaaggagcttcagaataggatcttcagttctaccaaatgtctctgcctaattacatcaatatccatgttgatgagtgtacaaacctgtggctaattatattttcacttcttctaagggtaggtacactaatgtgtgatcccacagaaaagggcatgaaagtaaattaaaggtgtgtgccatgtatattaatgcctttgtggttattattgctattgtcttactcccatggatattggaggattgttgataagacacttaaatgttgataaggcacctaatgagtatcctgtgtgataggagtagtacacaatgataatcatttccttctttgtgcattagtattgacatagccactaatcaggaactgtaaactctaaacttgtatctgcagccctcttattaaaaagattcctggatttttttccctaagctagaaacagacagacaaacaaaaacaatgattaaagggcactaaaagatatatttaaaggcagaggtttttttcctatgtgtataagattcaaattaaattcctctttttggctatttggacagttttggcaattgggctgaagccactatgtttttgtcataacaggtcaaggattgcttactcatgtttgagaagcaataatgatatggcaagagagaggtaagggactacaatgggaggcttattaggaattgtgcatgcctctttcatgtgtgttgtctccaagctaaccttgtgaggtacgaattatgacttcttcctgaaggagaaaagcaagttttagattaagtgcctgacattctgatgtcataaaaagactgaaataagcaacattttagcacaacatttgaacagcccttttcttaaggataagctctttgctctacaccatactaatttccaaaaaggtgtgagattgacatatgaaacttgtacgtttatataaatgtgaatgcagcaagccagagaacagaatgttctgtagcccaggcaagaggcagaggaaatacccagtgacagatctacttggccctcgactaaaggggcgctgtaactttaaaatactaataaatatttagcttggctttttctttcctatttgctaagtcctgtcttgattctctggctaaggggtgtaagaaagtggctgtttgtgataaatagttgtgtttgtgtgtgaatgcatggaagaacacatctgagataatatagtgtttactgctttgccattagcacaatgggctgtctttacagaatatgatgtttaaatctatgcaccagtgcactttcaaatagagaattcgcttcctgttttcacttaaaactctctttttattttaattaacgaaaaagcagtttaatcatccatctttgcagctaaggaagttttacaggcttataatactgtcagattctgcggtatataaatgagaaatagacacttttggggaagaaattggccagtcttccttccttccttcctttcttcctttcttctttccttcccactcctcccccctttccccccactctctctctctttcttcctatgaagagactgttctaaaagctaggaagtttcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctagagggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactgatactcactcaggagctgagatagcatttcatttatgcaattcaaatagctattggtttggataccttagtattgtttcttccaagaaatattttcattctttcctaaagggataataatagacattcatgacctaatttaggagataatcattttttattttatcactcattattaatgcttcatacgaaaactagatttatgaaaaggcccatggattttacatctattatatcatctcctgttggtttgagaatgaaatgtttgttttgctaatatgtttttctgattaagaagtggaggcagcaggctattaaaagtttttctcaaggcagtaaattggtagactagatatcttcaaattaaaaagtagtgatttcttaggcctgttcatagattattcaaaaatgggttaaagcacaggttgaaaatacttttatgggccacaggataatttaagtgattatttttcagccacttttttttggaaaacatatattagctaatgtctgtaactttattaacttaaaaacaaaagtccagataaaagaattttacactctgccaagcagtggtgcccagcttataggtggttggttctgcatcttacattttgttacttgtaaggtctatgaagaaaggactcccttttctgccctgctcactgtcaaaatttcagtctctacagcatgaagactctacatatagaagacactaaaattttttttaaatatatgaatgaagcagttaatttaaggcagcaaagtcacgcctatacattatttctgtaatgtttaattttaagtataattgcttattaagtagataggatgcttagaaactatatttacctggaagtggcttaaaaatttccctatagacaaaaaatataatttgaagtagttcgtcttcaaaataaaggcctccagatggccagatacctttcatgtacatgcatcaattagactgtaccagaagataataaaaagaatcctattgttttaattatctcttttattctccaaggaacccctattcctgccaattcttacagacgttattaaggcattcagttagtttttcattcatttatttaaaaaatatttatcatgccaagtactatttaaatggtggagataccaaagtgaatgagatacatacaaggggccctagttctcaaggagctcacattcatgagaaattaagttcacacatgcaagatataccagatattaataagtattactcagatcattaaactagaatgaggccaggcacagtggctcatggctgtaatcctagtgccttttagaggctaaggtgggaggatagcttgagcccaggagttccaggatacagtgagctatgatcactccactgcactccagcctgggtgatagagtgagaccctgtctctaaagaaacaaacaaacaaaaagtagaaagatttgacctgagaataactagatagctattttagatcaggtattcatgaataaaataacacttaaagtgagatctgaatgacagaaagaaaagccatgcaaaaatcaaggagtagggtgtgcagatttcacagatggcaaatacctaacatggtgatgctaaagtcagcatgaacctccttctgtttcttgaacagaccacaggctggagaagaaaaggtaggaagaaggctggtataagatgagggtgaagagagaaccaaggccagatcatgggagctttatagccaggctaaggtgtttatgtttaattctaaatatagcagaatacattggagaagactatgctgaggaataatgtgacttgacttaaatttttaaaagactacctaactgtgtatggaaaatgaattgcatgggacaaggatggaaactagttgggagatgagttagaagattattataggagtccttgtgggaagtgttggtgactgttggagggtagtggtggtagtgaagatgcataggagtttctgagcttgttttggaggtagaggaggcaagatttgttaaagaactggcttagcagggtgggcacaaaggaaatacagaattaaaggataattccaaaggttccaacctgagcaactaagtagaggctggcatttactaagatgggtgagattgagagaaggggagtatcaggaggcaagattacttgttattttttagccatgtttacatttttttgagatatcttctgagtatctgagaagaaatttcaagtgggcaatttgttggacaagtttttggttcatgggagaaattaggacatggatgcaattttgtgagcctgtaacacacagctagtatttagagctaagggtctatatgaaatcacctaaatagtacttatagatatgaaagagaaggacagagcccaggggtactcttacatttacaggtgagcataaaaaagaaatcaaaagaaactctaaaggatcaaaagcaaagtagaagaaaaccaaacagccatgcgggagtgattgttgagatgttttgaaaaagagaaggttgacagtcatttaggaaggtgaggaatcaaacacagtgcagatgagggtggtgtagggagatcattctctaggtgccctttgcatttttgctcatcttacgatcagagtcactaactctcttggttcaggagttggaagatacagtggcctgttccagagcaaaggcaggttcagttgctgttcaggataatgaagataatgcctcccactgaggcaaagatcaacagagcttactgcccattataaaatattcagattccttaagcgcatggttcctctcctataatacaaacctcttgcaggtactgttgtcacctggcccttttcatatcaccctgtgaggagtggggcccagagaacctacacaaatgcaaacacttcaaccactgctattgtcataaagtccgtggtctctgacccaaagtctcatgtcccctgctagcatccatgaaacagtggcaggtgaactttgaaaacaggataggctaaaatctcagatccttcactactcttcacagatagtaggccattgtgatggtctacttgagctctgttgttgtggtggcatatctttctgtaccgatattcagttggtttgatgcaagcatggtacaggtagatgggtttatgccttagatatttaataagaatgccttaacacatgatcatatgtcttctttcttcactgacaatggcaccccactaatggagtgtgcaaatccaggaagaccagtgtttgaacgttgtggggtaaagtgccgataggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtatatatatactttatatatgtatatatacatatcctatgtgtgtgggtatatatatatatatatatatatatatatatatatatgaatgatgcatggagagatatctctccatgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgaggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctaggccatattgaggaaggccaatgcagttttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaactaaagagcttctgcacagcaaaagaaactaccatcagagtaaacaggcagcctacagaatgggagaaaatttttgcaatctattcatctgtcaaagggctaatatccagaatctacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattagctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttctcagaacattcttttttttttttttttttttttttttttttttttaagatagagtcttactctgtcacccaggctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcacacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacctagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagatacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactaggaagaccattgatgtgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttctttttagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtgatccaccttccttgtcttcccaaagtgctgagattatagacgtgagccaccacacccagcctcattcattcatttattcattcaacaagtattaattgtgtgcctactataggccaagtgtattttgggccaagtgcatttctatgagctaaggatatagcagggaataaaacagttacctccatcctcatggcacttacattcatgtacctgcaatccccatcagaatcagcaactaggaagagatgatatcagagcttgaacgtggatccagtaatacccatggatagttctgtggaagtaccacagagaaaaattcaaaggaaagaggaataggatatattgagatacaaaaagtgtagcaatggaaaatcaggtgatcagattattgagaatgaaatatctttagtaaagatttgaaggagttgagtagagatatctcctagatatctacacctacatagaagatcatgccaagaggaggagcagcatgttcaaaggagagaatgggtatgacatgtttgaagaatagtcagtagtttggtatggctacagctgactcagtgagatgggaatgaggtcagaaagatgaggaaagggcagtccagattgtgttgggctttgcttgcaaaaacttcagctcttacttggtataagacagcaaaccattgaaagagtttgtgtagaggagtgacatgatctgacttcttttttaacaagatggctcttattgtatcattaacagcatggttttacatgaacctatcgttttgtttagtttgtgggtcaggactgaacaatgaaagtagaagcagtcctgtgacagtggcactaattacatttattgtcatagagaaagctcatgccagtcacatactagtcagaggagttttcagtcctaattgccacagaacaaatgactttggatgttaaatggactatagtcccctcatttgcaaagtggggatagtagtatctatatagtgaattatgagaagtaaatgagaaataacatttgtgaaaatgtctgacaaaatgcctgaggtgttaacggatcttttaaaatgttaactgtagcctcaatggattgtaagaatatacacatttaaacccattgacataaattatggctagaatgaaagttttgatcatcttgatgatagtttttgtcttttgggtttctttcttgtgtgttctatctgaagaaaatcatctgaaatccctcatttagaaattgaaatattttatgtcagcaagcacatatgttaatgatttcctgaatcagaaatgtgttcaaaatcatatctatagcaatgatcaccacagcggtagttctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtgtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatttttttccccagtgattctctgaacgtgtgttactaccatccaggagcagaactatatcttgctgagacatttgtgataatgacaaaacgtttcaatcagaaatttgagataaggatatataaatgattttttctcatgagaaataaaacgcaggtgtgttcaccaaaatcctgctcttttactcaatccccttggccaaaagtaagcacgacctctctggcattgtgaacaaaaagaggaattaactcaaaaagactaattttatgcattagatgatcctttagaataatcaagcatatgagtattagggtaacttatcctttttacttttcctgagggaggtaagagtagcaccgacttgctactgctaaagatatggactattggcctgggagggtaagcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacattagaactgaaactagaaccagttttattggaagatgatggaaaagcaccttgtgatttatctcttttggtagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatagaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatcttcattatcagaataatgcccctccatgtccacaattattaatttttatagatttagggggtacaagtgcagtttcattacatggatgtattgtgtaatggtgaagtctcggctttttgtgtagccatcacctgaatatagtgtacattgtacgcattaagtaattcctcatccctttcccacaacctccacccttctgagtctccagtgtctataattccactttctgtgtccacgtgtacacgttatttagcagccacttataagtgagaacatgcagtatttgactttctgtttctgagttattcatgaccagaattattattctaattattgtgaaataaaaattatgcctgactaaaatgactgaatccagaacttcaccataatccatctatctcctccgtgagtcagtgcatattacctattccaatgacctcttcagtactgtaaatattactgtgttccttttatttacttaataaatagatgtcaaatgtgtggaaaacaacatttgttttttcaaatacatgtttataacaccctttggaggaagtaagcctctagaacatgacagtctctggggtatgctattttcaggtaattttaaatgtcgctttccaacaaaaatgcaatactattatctttttttttaatgacaaagaaaagcaaaacaagtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattttaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatgtgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggttaatgcacgagaaaagaaatgcctaggtctctgtctaatgtctatgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaattttttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatgatctatatgaaagactgtttttgataatttttgttttcttatacataccttccaatattgtccaaattttcaataataagcatgcatagcctaatatatcatgtagatgagtgcaaaatgaacacagagattaagatcatgggcttttcaatgaaggtctgagtttgaatcctgtctctgccatttactagcaatataatttcaggaaataacttaacatctctgctcttcagtttcctcatctgaaatataaggataataatggtatctgtgccttaaggatgaccaaagttatagatatcttaagaatgaattaaatgcgtttctctccatggactattttaacaatgaatgcctgacatagcaattatgttccataatcaccattatttatttataaaattatttagtattatttaatactaacattctggttttataaaaccaaattttaaaaatagataagtaaatgaaaggacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactggggtaaacctgtttggaaaggattgagtccttctctcaattttgaagggatgattttttagttcttcagatttatcttctgtaaataaatttcttcagaagcttcctgcaatatgataaacacaaatgattaggaagtgttttgtaaggattggggactaaagaaattattgatgaagccagaatgtgtcaaaaaggtgtcgtaaagcagcaatacttaaacattttggtctcagagtccctttacaatccaggacccaaagaggtttttttgtgtttgttttttgtttttttctaaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaacagctttcatctcacagacctcccgaaagggtcttgaagatccatgagcaatccctggaccacactttgagaaccgcttttgtaacgtgtgaccttcccttatcctctgccatgcgaaactatctcagaatctaagattgtctacagccacggtacaaccagctctgagactttgaagagaagaaaagatgaacttcatcactaaaaaagccaaagtagttgaaagcaaacactagctgaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctctttcttctttaaccatagataaatgtcccaagaaaagggaagagaaacagaaaaatcatacatgctaaacaccagtttattaaatatatttgttgctgtttttcttttttacttggttgctcacaatattaatacaccctctttataaaacatgaaagcaatacaaaagtataatgagtaaaatgagaatcctaaaatgttttcttccataatcctctctctaatcgcatttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggatgaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctctagcatgcacatcactttacacaactgatggtaatttatgaggaattctatgtcccctcactccaacactgcatctagtcactctttgaaaattgtccagtctaatgggtgaattatggcatcttgctttgttatgcatttctgtgattaccagtgaacttgaacatctttccatatttttatttatgtttaacatcgaaacacgttacgttttgaatattttcctctactctattactgccttttatccttgattatagtttcttccatcacacagcaggcttgaatttttgtgtacttaaatttgccaatcttttcatttctggttcctgagtttttttgtttaacttaggaaccacctcctcccatactatctccaaggatagaaaaatactgttttctcctagagcttttgtgaactttattttttacaattatatctttagtccattgatggctgtgccttttaaataatgaaaagtccatatttaagttatttttttcccaaatagataaacatttgccttacaggatttagtaagcattttatcctttcttcctacatttgaattgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaaataatacacataaaatacttaaaatagcgtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtaagtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaatctagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatattctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaatctgaatcattctattacaaagatacaggctcacatatgttcactgcagcactcttcacaatagcaaagacatggaatttacccaaatacccatcattgatagactggataaagaaaatgtggtacatatacaccatggaatactatgcagccataaaaaggaagaagatcatatcctttgcagggacatggatggagctagaagctattatcctcagcaaactaacacaggaacagaaaaccaaacaccacatgttcttacttataaatgggggctgaaaaatgagagcacatggacacaggagggtaacaacacacactggggcctgtcggggagcatgggagggagaacatcagaataaatagctaatgcatgttgggcttaatacataggtgatgggtcgataggtgcagcaaaccaccatggcacatgtttacctatgtgacaaacctgcacatcttgcacatgtatcccggaacttaaaattttaaaaaaatttaaaaaaaaagaaaatctgaacttgggtagcaatatctctacctaatgatactcttgatttttaagtacttaaaatgagtctgaaactgtagaggaagaaaaattcttcctaccaccctcctcctttctctggctggggctttgtaaattggactgacaaagacagcttaacaagagagaagcaggagtttattagtgtgtgcattgggctcacacgtgggagcactcagacgtgagtaactccaagggctggtaagaccttgagctaatatagaatctcagcaaaggaacaataaatttttagagaaatgacaagacaaaggaacgaactttgagtttctagggtggcagactgtgggaaagcaaatatatgggaaacctattgtagataaagattagttagggaagtttatgtggatgcctgtggttccgtctctggactcctaagggtctagagttgtctctgatgattaacttttatccttcctagtagagaggggagggaaaacacctttgcaaatttgtgtcctgcttttaggcaaacaggggcagggcagagagcttttcttatagctgttttctctcaaaattctgtcttcacatcaaaataatcccaatgccaaagtggcgtattttggggtggcatattcggctaccctacaggacctatgcaaagatatatctttatatatatttaaaccatagttttcaacaaagttggaaacaagaataaggattgatttaaaagatattatatagccattgacatcatgctgcataaaacctatttaattctcatctaactggtagattatacaaataataacattgctttcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgttacacataaaagaaagctgaatgggaaaaatgcatggaaattatgagtttagggacattttcacttggccaaatgccccattctctttctctacttccaggtcattgtgataggtattttaaatgaacttgaataatcccttaggacagggttgcctgaggaaatgggggacacccagtcaaattggaatttcagataaacaacaaataatttttagcagaattgtgtcctatgcttacttatactaatatatatacatatattttatttgcctgaaattcatatttatctgcactatatctggaaacattaagaataaattgtaacatcttgtatttgtataaggcaacattttaccaatcttttcttcagaatactagttttatgaaactcagcaaaaagggctatgtggtcccaaaagttgagaaggcatttcgtgctatagctcctcttgcttacagctgttaacttggagtgataatcacctgttctgacaaccagcatagactggactccttctagctgttaacacctctgcagcaggactgagaaaggactggagagccacgtgctatggtttacacctctgagcatttgctgtgtgccagccatcacactacatgctttacatacttcatctcactaatcctcacacacttatgaggaaactactgagagtgtatgcatgaggaaatgcctcagagaggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtgcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggtagggtgttttatatttatatctacataaatctatacattatctagatattatactatattatggaaatgtatatattatattagaattaatatttctaattatcgtatacagttatacattttattgtgttattataacatattatatataattggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttatcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatctagttcagaacataattctattagttagagccagcctaacaaaaataattaccttcccaaaccaactttagattatcatttgttttcaaggccatggttctcagccttagttgctcattaaaaatattcggggagggcaggcatgatggctcacacctgtaatccctgcactttgggagaccaaggcgggaggatctcttgagatcaggagttcaagaccagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtcattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatccatttcttaaatttattcattcattttaaaaactcaacttacaattcttgaaatctttacctaggatatgtcagccagtattctagacatctggtatacatcatagaacaaaacagtcctgcccccatgaagtttcattctagcttacccctagtatatgccaggctctgaactaagtctaaaacagatgatccctgcccttccagctccctgcaaagccagcattaataataggagggctttttacagaaaatgaaactgtgacttgtttaagttacaacctgtgagtgttgaagtcagagtaccagtctttcctgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaacagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagattgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttagtaaccatccttcatttatctcagggagcaaaggcaggatttccgtgggtgtccaaggtccttactcacagtcaggatgcatggcagtacccttaataactacagattcagaatcacagaagacatttaccgagtatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacatgattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaatctattgaaatgctccaccacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactggcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagatttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttgcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaactagtcggacctaagggagcagatattttccaaaaatatccttcccaccagccatgctgcagatgtgtcactgtggctcagaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaaggagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatctctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtattttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatacacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaaaaaagagataaaaataaagataaaaatgagtgggctctcacaaccttgtttttttctttttgtttttcacttactctcttggctttttaactccttccttctctgcctcttatgaatgacaccaggaagagttattgtaaacaattggaatttctaaagttctgtgtaactgttagtatattcactatatgcatggtataatttataaaattaatctttgaaactgttaacccctagaaacagaaagaaagaaagaaaaaaagaaagaaacataaagaaatcttgacccactataaatcctgttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggagttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacacatctgatgcactgttgtgtatttttgcacctcctcagcagtgctctagctagtctgtccttgtccttgtcaactgtacgtgaacatgatgccctctagtgactgcactttgtagatgctgtaggccccaaggaagccttgagaggaaaaaagagcttaatgaagttagagaagggaagggaggcccgtagcggaaaattatgggttataaaccaataaaagcagcaggaaaaataagcagcagctgactatgagtaagaggacaagatgcacaaagagggagaagagaaaataagcagaatagagagagaggtgagatgtagctgattttggaagagttcactgtggcctggaaggagaggaacaggaatctctgcccagctttgtttataaccggcagtaggtccttccgttcatgtaagctctgccctccacaactcaccctgtgactgcaaaatgagatagttaaaattaaggttcagaattctttgagtcaatgtaagaagatgagcgaaaagtacaatgaaaatgagaactgaaggaggaagagtctgtggaagcaatttccagaatcttgtttactgtgtctaaggtcacctcagtattgcagtaacttaataacaaccaagcggctgaatgaggcaagctcaggtggggtttggtcgatcgcaggatgatcctgtactcttgtagtaacaggagtgttttgcagtacagctccacccttcacaaggatccagcccctgtgagattgcatcctcttagactgaatgcctaggagtctcactgactacctgtctgaagagctccttcttcttttctgaattaatccttctttacttagaactatctgaggatcaagtgatcttccagtgggaggatatttaaacccagcttccccttgcaaattacagatgctataatcctgtctgcattaggcttaggtcatgctttctctaaacgaactgtgtattacaggaaagtaatcaaagtccacaagaactgtgtaattaaaccagtgatggtgcaaataatccagaagtctgtcattgctctctctagacaaaggatcactcaaagatgagaatttgaactaattttactgaaagacaggatgatgcagctgaatggaaagaacactgcataggggtcagaaggtgtggattttcattctgacatggacatttgctatctgcctgatcttctgcaatattctaaacttaacaaagccttatctatacaatgggaattaatccatttattcatatatattaaagattttcaatgtgccaggcactgtgttaaacttccagatggcagtgagaaacaaactctagaatttctgagtcatgataaagatgaaacaggtgttatattttaaaactcgaaatgtcataacagtgtaaggtactatgcattcctaaagcaacataaaacaatagggatttttccaaccttaaagagcagcatttaaaattgagtcttgccttgggagcctgtgacccacgggagcattggaaatgacatcaaccacgaagtcttttttcttccagtgaaatgcaaaacctgctacctccctggagctattagcttggccaaatagtcctctagttagtaagtggacaaagtagttactgcacggctaactgcaactcttcatttaaatatttccctcatgtccagataggatatgtctaatatcatatgcctaatagcttttcagcatctttccacacagaaagaaagggaaataagccttgtcatagccatgaagtgtccccaccaccagagtttcttctctgctacccctatgctgcctaggaatgctaaaactattttatggggccaccaggtggcagttagggcaaatggttttagtttttttctttctacattcttggggaagaccaggggcttaggaatggagaagcaagccttggaaataaaagcattatggagcatttgggggtgccaggccctgtgctatatgtgatatatgcaatacctcacccaatccttatatcaatatctgttaaatatactattgaacaggtgaagatagagtaatatgggaaataaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctacctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattccttactgtttccggtagagaatctgcagagagaatatttcactgaagcaaaattataaatggaacatttgactttatatttccatgtccccaaagatttactaaacattagatctgatttggccaactttttctaccaatatttccggctcttgatatgaaactagttaaagctattttttcccttcaatcagcacattttcaaacttagaacatctattactcaaatttggcataaaattatgcagccagctcattatccactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttccagtcctttttttctaaaaaaatattccaaatcattagatgaaactgttaaagataacgtttggaaagtttgtctcctctttggtgattaaaaagtgctttccatttttggcccatggctcttttcctggggcatagcatttgattataaagcttttctgatgaaagtatcacaggacagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatagagatagaatgtgtcctacaaatgtccatgcagcaactcatattcacttggcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattgtgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccgcagtgaatgaaatcaagcatttctctgtttctcctttcctttcggaatttcttttcctgaggcttgagaaggcaatactggtcttacttttcacatgagtcaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatatttattttgctttctctcagatattaagaattatgtctttcctttaacctccatcatttgtttttctactttggtggaagctttttgtttgtttctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatatcacttaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaagatgatacccacttgtgatatgattctactttcaatgtcacggtggaatcatttattagttttttaatttaatttttcacatgtgagtgtgatacagaacacctgatttttctacactataggatgtcagttcagtaaatcgattttcctcattagcaactgcttatcaatgactatgctgtatagaaagcaagagtattatactctatttttgatcacagataattgaagtaaatttaattagatccatatgaaagaaataagaactctcacaattgtgacatatatacgtgtctgtgcatatgtcatatcttagtatatgaggtatttgcatgtgcatacttaccaagttaaacgacctcctatcccacaaagttctctttagaaataaacttgagtctcttgtttgtgaaaccaaagagaatttcccgccaaagaaatacctacaaagaagtgtaggtaaagaattcaaatgattgactcaggcttaagatgatttgatagctctttctgcaccaagaaacacagaaaatctcaaagcaggcctgtgccaacttggtataaaaaaagccttcctaaagagtgcattatcttcaatgggaaacgtcgcagtacaccttggcatcaccaggtcaattagtgcaccggaaagatgcatgatatttcctgttggcagccacgaagtgagagaattggacggctactagccctgttgtgtgccaaggcctaaaaatcatgcaaggaggtgaaatgatgcgtgccaagaaaatagcaaccacaggaaacagcaaataatgtaaggttttgtgtctttactctagatgtaaatactcatttaccagggcagctttaaattgacagcttttgggtttgtgaggatattgtgagtcagggttctcctgattgggcaagatgaacgagtgaacaacatcactagggggccggagtagatgagatactcactcattcgtgtgcctgctttagcaccagcagtgtgggaatggggagaaggccaatggtctcaaggcagtttccagctctctggcaaacaagataaggccatggctgtaacagacaccctctgccaggttctaaaatctctctcttatgacctttttaagatctttaaagcaccgtctgcccttggccaacaaaagagaaaaaacagagtcaatgcggaaaacgctgccaagacaacattttcttcttaagatcctaaaagcaccattttccctttgctaacaagacaggagcaataaagagtcaattaggaatatgttgccaagacattggccatataatttctactccagtcggttttgggtttgatgcagtttagaattctctagacacattttttcatttttttttcttactagaacgcagaatgtttttgagagtagaggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaattctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaagttgcagagagggaaatggttgaagacaaatgtctcacgccttaaaatgttgctaaagtaagatggctgtttggatgagtcatcaacaagaacatcacctttgctctcttcctgccacccctgcacttctcaggctactgctcctaaaacctagaactcaggagtgatggaaatagagggcacccatggcaaggaagaaattggagagtaggaaactcagggaagttaatcctgaggaaagtggaaagtgactaaaacattttgagcagagaaaagtcaataaatcaaatatagaaacaagagatgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttatattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctattatctatctccatgaattcactaggagaaataggatttttgactaatgggtcagaagaagcaaaggaaaggaaaggaaaggaataaagaatgactcaggtttcttgcctaggaaattggttaaaaaaagggtatttttaattaaaaaaggagagttgaataggagactaatttgaaggagaaaatagcctatttttagatgtattaaatttatcaaatttgtgtgctgtatatcagggctcaatcacaattctggcataaatttatatattttatagaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctgtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaaaaatacaagcaaattagctgagtgtggtggcatgcgcctgcagtctcagcaactcgggaggctgagacagaattgaattcgagaggcggaggctgcagtgagccgagatcataccactgccctccagcctgggcaacagatcaggactccatctcaaaaaaaaaaaaaaaattaaattaaagttatttttcttttcttccattacccagactggagtgcagtggcatgatcacagctcactgcagcctcaacctcccaggctcaagtaatcctcccacctcagctttccaagtaactaggactacagatgcacatcaccatgcctggttaatttttgtaatttttgtagagatgaggttttgccatgttgcccaagttggtctcaaactcctgacctcaagtgatcctcccacctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgttttgtttctctgattgttctacagcttatagatactgaggttacattttatgaaacaaaagtaagaatacatgatttaaaagtaagatcaattcctaaaaattggacctgaaaattttatggatagagtagatagacgtgtagaattcatcccagcatagagttgctgggatattactggtgcttcttcacagggaaagaaacctggctacccagactacaaagggaaagggggaaaatggcctataactcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttacataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccatgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacacaagcaatcctcccacctcctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaaaagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtattgatttttgcttgcaaatgaaattcataaacagaattatcactgaaatttacatgcaagagaaattgatcaagatgatttgaaaacttatggaaagattgaaggttgccaaaatctttctctttctaacttcctacctttatgtacatttacactctaatcacaggtatttacaggccttaattttaacgaaaatgaagaaaaccaagaaagaaacagctctttagagcaatggaaaatcttctatgatttctcactgacattggctagatactctgcatttatgagcaatcatgcatgtatatcatcagatttaaccttcacaacaattccatatatattatcagatttaatcctcataatagtttgctatcctaggttttagtttagaaaactgagcctcccataagctaagaagttacttgtccaatatcacaactttagataatggtagacttagattaaatccatatttgctcgctctacattccatattcttcccatttaattgaacaagattttggaataaagttgaaatccacaaaaggaataggacagtgacttcacaataaaaatattaaatgtggcagaaagtatggatgtcaatggaatgtaaattctgggcctcctcaaaaacttgatatactcatcctgtgttagttgtgaaataaacaggttggagagtgaggaaatgtggtttttgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattaatagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctgacaaactgaaggtcatggctaacagagtctccatatcagtgaatctcaaacatctgtttacataaatagcatcttcttataaaaaaatacaaattctgagcccccatcccattatagttggtaagtctaggatgagaccagaaggggtcattttaatgagattttcagatgactttgaatttatatttaatatttattctggtttgcctggggttgaagggttccccagggcatgagactttcagtcttaggcaaactggaatagttggtcactcagatttcggtgcagtggttaaagttaacactttcaaaaatattgtagtgatctagatttggttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttcaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgttttttgtttttctgaagtgaatgacatcgttttttggaatgaaaaggtcttgccccaccctgcaagtgtatctctgcctttgagacaatttagccctggaatcaaacctgggggggaaaatcaaattatgatattaaagaaaacgctgacaaatttctaaattcctttcctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccatgaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagaggagaaagaggcaggaaggaaatgcaggagaaatgtgggaatcacagttaacctgaaggattactttggctgtccccttcagctaatgtgaacattctggcagtcagatgcagccctgtgagaaacatctatcagacatcctaagtagatgctccaactgctgtttttcatgtacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtgcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcattatgtccactttcttttgagtttttgtgttagccctgcattgctataatttccaacatcccctggaacataatgaaaaccagagaattgctttttttttctgggtccattttattacattcttttacatctcttacttaactacttctaatgcctttgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcgctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttacttccatgagtttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttgtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcctggccaaaatggtgaaaccctgtctctactaaaaatcttagctgggcttggtgacatgcacctatagtcccagctacttgggaggctggggcaggagaatcgcttgaacatggcggagattgcagtgagccaagattgtccagcctggacaatagagactctttctcaaaaagaaaaaaaaaaaaaaacctttaggaaggataaaactcatttcctctatcagcatagtgtcaccatattacagaagtatcaaggtcaagtattaagactactgaggctcaggtgtccttggctgaagggagagagaggataccattcttgcatagtcttcagggcagcagtaatcagcaaactgataggttgcttctgggtctaaacccactgtaatcatttgcttgtagagatgacaaagttatcagttgtacttacatccactttttttgttgtttcagaagcttaccacacttctcccagtttccttttaattagtttgtaattttaaatcattacattaagataagaggtttttattaaatttggtagaactcatggtaggtcctacagaaatcactgaacttggcagccaaaaacagtgaccaggctgaggatgtgcctgaattgaacagggagatgctatttacttcttaacagagacatacttttcacgcagaaacttggcaactggaggagaaaaacacagaggtgaaggggaaagaagactattctggaaattaacaggtttcaattttggttgttcttcaacttgttagctatgtggccagaaataagcctcttaaactctctattccttggtttcttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctaggtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaacactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaaacaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctcttggacatttatcccagagaagtaaaaacttagactcagtaaaaacctgtacatgaatattaatagctgttttatttgtaaaagccccaaactggaaacaacccaaatatccttagatcagtgactggttaaacaaactgtagcacagctatactatgacatactatgaagcaataaaaaaggaatgagctattgatacagacaaaaccatggatgaatttcaagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctattctgtatcctcattgctggtgttcacgtgaatctacatatgtgataacatttgatggaaccaaatacacacacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttagagactctttcagattttttattttgagatttaatcaattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaaagatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcagaccacactctggaaactactgccatagaacatctgagagtcacaatttgaaactgtctcaagaaatttctaagtaaaatgcaatgcaataaattacttaagaattctctatatttacaactctttatttgtatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgcaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcctcctgagtagctgggactacaggtcccaggtgcccagctatttttaaaattttttgtagagacaagtcttgctatgttgcccaggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcagggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccagctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtgaagatgtgaaggagggtagagatgactgtgattattaatcatcttatttgttgatcatattaaaatgacaaaaaccacaattattttgcaccaacctaatatttcagcagatgtcctctgaatcagaagtaaatagccatgataatcttaccattagttattttattgagcaattacaagtcccaggctcttacgtttttatattaattttttacaaccagtttatgcgatgcatactgtcctcatttatcatataaggaaactaaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtccttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagacgagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattagggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaaacttttgtatgcctgtgaaattcatatcttgaaggcctaatctctactgtgacggtgtttgagatggggcgtctgtgaggctttaataggtttagatgaggtcaggagagtgaagtgcttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacgcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaacatattgaaaaacgtagacttgctatctttatattccacatgttggcagattctttccaagaaaagtgattttcagatcattccttaggagcgttgaggctgagaagtggtctttgcatatttatatttagaaattatcgagtccaaaatctaaatattgagtcttggtagaagagaaaaccagtcacaatttatgtaaaatagttgttcctaggtaatgaaccaaagcagggactatatttgagaagtagaatggtattgtcaaagtcagtgtacaatcaggaaattaaagagattattttatccaaactattgcagttaatgaggaatgtctcaaaagaaagggaagcagggttttatagatataggggaacaaaaagtttaagggatttcttaaccaccacttttttctagaagcatagggattaggtcacattcaacattttcagtccccacttctacttcagatcaataaacattataggatgctgaacaacatagaggtgatcatcagaaacctgagtaagactgagcagggtctaagaaatagtctctcaagagttcttgttggcattattgtcgtaacatcacctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccgttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagttggacttcagctggcagaatttcttcaactcctggagaaaagagctagctgctagacaacctagagttccaacaggaatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaaaggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacattgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcagtaaatgcctctcttttagaggtcccaaaaatatctcaagttttctgagcctgcgaggaagtatcctttacctgtaaatttgggcacctcattagccaggaatcaggctgattttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattgttatgagtttcagttagtttaagagaaaatagaaagaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttaagacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgttctcacttacatgaggaatcttaaaataatcacactcgaagcagatagaatggcggttacaggggatgggggtggagggaatggggaggtgatggtcaaaggctataaaatctttattaggaggaatctgtttttgttttttgagttctagtgtacagtgtggtaagtgtagttaataataaagtgttgtacatttcaaaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaagaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagttggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcaggagattgggacactttactaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatggaatctttgccttctaggcagattactcagaaggtaaagaaaaaatattattaagagtagactaagaagtcaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaactagctatatgacttcagaataaaatgactctatttttttcttaacaaaaacatgttctgcaaaccttgcatacaaaattgtatctctctgctattattatgccttgtagaatctcattcatgtatattgattataatttttaaatagaaatagtaacatctgttgcacaaagaaaaaagggaaatggataattgtgatctttctgtcatacataagctttttgtaacacactagtggaactcatgaatacacatctcacaacttttaatagccatgcatattatttacagcacgacttatgcaaagtggcaaaaatgaacacatttattaacaaaactgaatgtacatgcttctctatagcatatagaaacaaaaggcaaaaaagtatataaacttaaaattatgcttggttaccaatatttcacttttctctcttgcatagaaattacataaatatccaattaatattcattaattaattcaatttagcttcaatccaaggttttaaattaccaaatatcttggaatttgtcttcaggctgacatgctccaaaatattagtaccattgaaagtttgttagaataatgactcaatttgcttaaacacaaatttttattttctattgtattaaacattaagtagaagtaatgctaggttatttggttggtaaatctaagtttaggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagagacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtaggtgcatgccaccgtatctggccaacagggaaatattacatactctaacaatgagtggtgacttcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaattctctgttgtctttcacccataagatacaagatctctaaaagtcattaatcccctctcagagatcaccaagtggtcagaccacaaaaccaaagccagtgccagaaatcaagtgagtactaaaaccttgccttgctaccaatagacaagggtccatatcacaggaccaggagttagacttattcatagttccttggaccaggaatggagcacaaagggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctataggggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccggaagcacagggctcaggtaagattgaatatttttcatgcctttcatcctctctgtctgatctctttcaaactgtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttgatgagaagcaagaacaaggtctacattagtggatcacagactttttgccactgagatccaccatcgaaaatgcattcattattacctctgcatgtgtttatttaactgcaacaatagtttaatgattttcataacacaaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtgtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgttaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccacttatgagtaagaatatgcagtgtttgtttttctgttcctgtgttagtttgctgagaataatagctttcagcttcatccatgtccctgcaaaggacacaaactcaaccttttttatggttgcgtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctggttctagattcttgaggaatcgccgcactgtcttccacaatggttgaactaatttacactcccaacagtgtaaaagtgttcctatttctccacatcttctctagcatcttgtttcctgatgttttaatgatcgccattcaaaccggcgtgagatggtatctcattgtggttttgagttgcatttctctaatgaccagtgatgatgagttgcgtttctctaatgaccagtgatgatgattttctcatatgtttgttagccgcataatggtcatttctctaatgttagctgcataatgtcatttctctaatgaccagtgatgatgagttgcatttctctaatgaccagtgatgacgattttttcatatgtttgttagccacataaatgtcttcttttgtgaagtatctgctcatgtcctttgcccattttttgatgggattgtttttttcttgtaaatttgtttaggttccttgtagatcctggatattagccctttgtcagatggatagattgcaaaatttttctctcattctgtaggttgcctgttcactctgataatagtttcttttgctgtgcaaaagctctttagtttaattagatcctgttcatcaattttggattttgttgccattgcttttggtgttttaatcatgaagtttttgcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgtttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaaatttaaagtagttttatctaattctgtgaagaaagtcaatagtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgtttttgtattctgaaactttgctgaaattgcttatcattttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaagtagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtattttattcaggatttttgcatcaatgttcatcagggttattagcctggcattttctttttttgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcaatttcagaacttgttattggtctattcagggatttgacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttattagtctggctagtggtctatctattttttaatcttttcaaaaaaccagctcttggattcattgattttttaaagggtttttcatgtctctatctccttccgttctgctctgttcttagttatttcttgccttctgctagcttttgaatttgtttgctcttgcttctctagttcttttaactgtgatgttagggtgtctttcccactttctcctgtgggcatttagtgctataaatttccgtctacacactgctttagctgtgtcccagatattctggtacgctgtgtctttgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgtttcacttccaattatgtggtcagttttagaataagtgagatgtggtgctgagaagaatgtaaattctgttgatttggggtgtagagttctgtagatgtccattaagtctgcttagtccagagctgagttcaatggaatatccttgttaattttctgtcttgttgatctgtctaatgttgacagtcaggtattaaagtccccactattattgtgtgggagtctaagtctctttgtaggtctctaagaacttgctttatgaatctgggtgctcctcatattgggaatctggttgctccttgtatttggatgtgtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcacgtgagacgtgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaatttggtatgtttttgtggtggctgttaccagtttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttctggcttgtagggtttctgcagagaattcctctgttagtcttggactttcttgaagaaatgggcttctctttgtgggcaacttgacctttctctctggctgcccttaacattttttcctttatttcaaccttggtgaatctgacgattgtgtgtcttggggttgctcttcttgaggattatctttatggtgttctctgtatttcctgaatttgaatgttggcctctcttgccaggttggggaagttctcctggataatatcctgaagagtgttttccaacttggttccattctccccgtgactttcaggtacactaatcaaatgtaagtttggtcttttcacgtagtcccatatttcttaggggctttgtttgttccttttcattcttttttctctaatctcgtcttcatgctttatttcattaagttgatcttcagtctctgatagtctttcttctgcctgatctattcagctgtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattctccatccagttttgttcccttgctggtgaggagtttgtgatcctttggaggagaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtctgcaggagtttgctggaggtccactcgagaccctgtttgtgtctacggccataccaccctgaatgcgcccgatctcgtctgatctcagaagctaagcagggtcgggcctggttatacttggatgggagaccctgtttgcctgggtatcaccagcagaggctgcagaacagcaaagattgttgcctgttccttcctctgaaaactttgtcccagagggacacctgccagatgccagctggagctctcttgtgtgaggtgtctgtcaacccctgctgggaggtttctcccagtcgagagggatggggatcagggagccacttgaggaggcagtctgtcccttagcagaacttgagcactgtgctaggagttctgctgctctcttcagagccggcaggaaggaatgtttaagtctgctgaagctgcacccccagctgccccttcccccgggtgctctgttccagggagatgggagttttatctataaacccctgcctggagctgctgcctttctttcagagatgccctgcccagagaggaggaatctagagaggcaatctgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcctgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattggaaaatatagaacttttccttctcacattcaacttcttgagaggatctctttgataatgtgttcatgtacacagttcacatcaaatatatataacatgtggatcaaagtgttaagatattcttctttacatatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcagggcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaagtataaccatattttgtgcagaatgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctcctgaaggcttccttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcactttgcttctaagaactcatttattccttacaacactgtaagtactgttatccccattgcacagacaagaaaaatgagcttctgtattagtccattttcacactgctataaagaacttcctaagactgggtaatgtatagaggaaagaggtttaattgactcacagttctgcatggctagggaggcctcaggaaacgtacagttatgtggaagaggaagcaggcatatcttacatggtggcaggtgagagagagagagagtgtgtgaaggaggaactgtcaaacacttataaaaccatcagatctcgtgagaactcactcactatcacaaggttttttgcacagacaaaaccacccccatgatccaatcacctcccactaggtccctctctccacacatggggattatggggattacaattcgagatgagatttggatgtgggcacagccaaaacatatcaggtacaaacaaatagtggagttaaaaatcaaacatggaccatctgcctctgtagtccaggcccttaaccactacattatataacctcttgagagaggaaaacttagattgggcaatattagcatccaattgccagtgcaaaaggaaatggaagtcagcacaccagcttattacttacccgagatcaataagagacctgcaaatacttgactccgggttatagacttggtaaatccaaatgatttctctcatgaatccgaatccctgccagtaatgcagatattctaacttgagacttaccttccagactgaaaatgccaaatgagaaaaaccaagtaagtttgagtttctgcagttacaaagtgctatggtttgaatgtccctatcaaaactcaggttgaaataaaattgccattgtaatggtattaggagatggggcctttaacaggcgattaggccatgagggctctgccttcataaatacattaatgtcattattgcaggagtgggttagttatcacaggagtgggttagttattgtgggagagggttcctgataaaagcataaatttcacccccgtccactccatcttcagtgctcacttcatccttccaccttctgccatgggatcaccatccccagatgccagcatgatgttcttggacttcccagccccagaaccatgagccaaataacttctcttctttataaattgcccagttgatggtattctgttatagcagcagaaaacagacaagacataaaggaagacacataattaccctcccccaacagttcatgttacccctcaacattgttttagtcagtgcaagactaccaaagtataggtgtctgaacatcagggaaatgtaaatagagaaggtaaatgaattcaaccttccttttccctatactctcatttctgtcaaatataaaaacctgtgggttttacccttgttccagtttacataatcacattccaaattacttatgtggacttttatgagggctttttttctttacacctctctccttttctcatcagcctctgcaatcagctttatacaagagttatatttcattcatttcattttcttttctttctatttcacaagttctgggacttggctgtcaaccgaatcttgaacttggtaattaaattgttcataagctccaaacatgttgtaactcatgtcatattcatgtacacttctctgccccaacttgataaaatgagtgatactgggacaccattgtcatacacacctccaaacctgggtgtgtccacttcaaatgcctgaacttgctcaaatagaaatgggattactaaaacaactatatatcctcaccatgctggttttagtaggaaagatgcatcaaggataaagctctccagtgaaaagcatggggctgaaagaaggaagtctctctgaggcagaagtcctttggaaaaactgaagatgacgtcctagataattttgaagtcttatgtagcaacagaagtttatgtcattaatttagcaaatagtcatagacaaaacatgcaactttagagcaagtgccaggctgtgccaataattccacccttcacctccacatggggtcagtccatagaacaaaataccaaaggccttagtgctcaggtcttttgctcctgacattctcccttcatcctttccctatccccacttatccttttttaatgcactatagatgagtatgtcttaatttcttaagttaatttgcattggcattaagcacctactttatttatttcctttctcaacaactctcagactttgattcttcatgtccttccagggccctgccccatgccttctgctaaatgctaaagtcatgcaacagtttagtactgcgtagagtaggatggctagcaaaaggaaatctctcaaaggagcttcatgctctctgtgactcagggtagcagtatatggccttcggcacccactgtgggctgggctatggcagactttgcttgccctcattgctctctttgctttccttgatcttgcccctgtctgtcttcattttctcccttctcacttttttccctattgttacttacagtttaagttatggaagaaaaacacttaatgcttattggccactggaggatacacctcataacttggaaaatgaaaataaacactttaatagttttgtacttgatatgatgactcttttaaacaaaacactttttatctaggcatgaccttagatttatgggaaaagaaagttgcaaagatagtacagagagttcctgtatacctgtcttctagcttatgctaatgtggaaaacttacataagtgtggcacagttgtccaaaaaataaattcacattggtataattctattcactcaaattcagactttactcatatttcatcagttttttcattattatcctttttcttttcccagatctaattcagaataacacgtgtgttactacatgatgatttaaaatgtttacaaaaacaagacctctacctatgctcctattagtgtgtgtgtgtgtgtgtgtgtgtgtgtgtgctggtgtgtgtatatctttatttaataataaaactagaagggcaatgaattcgaaacggaggcttttcttactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgcgcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaatattctttcctttgccggtattattaagactatcttgcattgggattcatgcccccaggcttacagttctctgagctatacttgcatacactgtcctcagtgaacctgggctttggatccagatcgccttgaattcaaaccctagatctgccacttaaagactcaagaaacttacataacctttttgtaattgttctctatctataataaatgaaaagtattactaattattacttacatgcaagattgttgtgagcgtaaaccacatgatgtgtggaaggtttggggcacagcattctttaccaattcagggtaaccctgaaaacttaggaaaaagagaggattcatataaatcacaaattttgcaaatgcattttaaatcctctctttgttccagctccttgtacagacaggactgcttgctactaagaatttccaacacaacctccaattaaatagttctttgatgtatagtgggtacagaagaagtccaacttatttgcatttgcagaatcaggagacccccccaaaaaatgctggaggtgtgaaagcaagaatcagaatttgtcaggattctccgtaaagtactagcggttttgtagatgctttgcagctgtggaactataaacactcaaccgcagacacctcattttatatctcttctatgtggtatatttcccttgtgaaaatgtgtatttttaaaattcactctgcaaaatgacagtcaatgttatcaaatatacatttatatgcccttgattgtaaaacccactacaaagtttattaccttaagtttaatagaaaacaattttgaaaaatgggaaaaaaatatatctgtcacagggaagtggttagaggttctaacagaggagatttcttgttagaataatttgttgtattttggttatacattttttgtttttctttcgaatgttgaaaaagttaagaatatattaatacatggacaggttagaaaatatgtaaataataggttggtcaaatcctgcagatgacaaatcatgagagtttgccaagctaaggggccctggccactcataccatccctttatctaactcttcctcctcatccagtcccataataaaaaatattaagcttgcacgtggtaccttctcttctaggctacttgttaatgggtcctcttaattggctatgtataaaataagattcccatgggcagaaatctttatctgatctgttcatggacatatccaagtgtcaactagattttggcacacagtagatgtttggtaaatatgtattgaatgaatgacagacactgtgctccacattgtaaacacatcatatcatttaatcattataacatccctatgctatcccctatgtgctattattagctccatggtacagacaataatcaggatagatcaggaaactaaccaaggttacacggacagtacctagatggcaggaggccccaaagcatgtgtactaagcattatggcacactgccttcctgtctggcattcttgggacatgcatgtgtgagcgataaggtaagtccaggaaagcgtggggcactgggagaatgtagaagtagggatgatggaatttcatttccacagtgagagccccccatcctgctcccattgtcagacccgcactttttgttatctcttttccttctgtcttgctacgtttgctttgtcttcttcctcgatagtttcccaaagactttaaacgactaactatcaaagaagagaatatatgtgaagtcactagttacttttctgctcaattagctatatatagattaactttttaaaaaaatattttccccatacacccactcacataactgtgaagcttaggaaaaatttcaagattatcgtgggtgggccccatataaatccccacactgtcaattctcccagcagctgtttcttaattcgtcatcagtgtagaaatctaaatcagcactcagtgaaatctaaaagtccaaaagatttatttcaaatttcaaacctcctccctaatgttctgaggctgtgtcaacacaggtagagagacggggagagctgagggtatttaagaatcacataatgtgagaaactgaggagaccctagggatcttttagccctaccccctcatttacacataaggaaatgggatctgaggccaacagcaaacttgcctgcctgctatctgggaagttctattaataacacactgtcatgggggaaaaaattcatacaggtaataaaggtttgttattttcaaagattaacattctttattaattaccacttttttgaaactgacacagccacaaaaaactcctgtataagaagaatttgtctaataaattgtatgattgtttattgggtatctgtttattttcttaatttttaattgtctgtcaatccttcttgatttaaagtagtcacataaatatataaatgtaaagagttaatataactaattgaattcatttgagggaaaaaaattaaattttctttttaaaaaaagaaagaaaacattaaagacagaggtaacattagcacaaaaaaatgtgtataatcaaagtctagagggaggcctaaatgtaaatcaagctttctagtaagcaaaaacaaaagagaaaacctggttaactccaaggttcagaattgctgtgatatgcagacaaaccagctgtgaagacactgcacaacagtctatgataaaaagacgggagggacatttcttgtttgtatagcaaaggtctacaatttgcaatgcactgtggtaaaacagaaaccataagctgaatgcttttgtcactgaacttatattttagttagaaaagacataagaaactaattgtggcatttaacttataatttagttagaaaagactaaaaaagctaactgtggcatgaatgagaaagaaattactgctctattagtggttccaatactgtgaggccacaggaaaaaaaaaaaggattctgaaagatacggtttggaaagacttcgtggaggaagtggcatatcaacagggacttgaaggctgcctagatatgcaaagaaaaagttcaacggaaatacaggatgaaagaattgggtggtcaaaggaacaaacccacttgctgatagattgtcaaaaagtatagtgtctgcactactatgtgacgatgacattttttttccctttgtcatctaaaattgctatcaggccgggtgcagtgactcacgcctgtaatccaagcactgtgggaggccaaggcaggaggattgcttgtgtccaggagtttaagacaacctggcaaatatggtgagacctctctacagaaaaaattttaaattatctaagcatagtggtgtacacctatagtcccagctactcaggaggctcagataggaagatctcttgatcccaggaggtggtggctgcagtgagccaagattgtaccactgcactccagcctgggcaacagagagagaccctatctaaaaaagaattaattaattaaaaaaataatattgctgtcagtaaagactgactagtctgtgtgatatttatcatagctatatttcataactccagtgacctttttaaataaaaagtaaggtccagttgaccctccctgtctgtaggttctgcatacattcaaccaaccatgggtcaaaaatattcagaaaaaaaaatttaaaaatacaataaaaactaatgtaggctgggtgggtgcaatagctcacacctataatccttgcaatttgggaggctgtggctagaggatcacttgagctcaggagttttaggtcagcctggcaacatggtgagaacctgtgtctactaaaagtttaaaaaattagctgggtttggtggcatgcatctgtagacccagctactggggaggctgagatgggaggatcacttgatcctaggaggtggaggctatagtgagccatgattgcaccgctgcactccaacctgggtgacagaatgagaccctgtctttaaaaaaataataaaaataaaaatcaatacaatataacaactatttagatagcatttatgttatattaggtattacaagtaatctagagatgatttaaaatataggaaagaatgtatgtagcttataggcaaatactacgccgttttacatcagggacttgagcatttgcagattttggtatccttggggggtcctggaaccaatactttgaggatactaagagatgattgtccattaaaaatgttttaccataaaggaaacattttatctcttctgtgtcagtctgtgaccttttgggtggaatctgaacaatgtgtaaatgatagtttcccaacagtgtgcgctgatgtgtaggagtagaaaatgatcctttggttttcatataaaaactttcttatgaaacatgaagctaacaaccaagaagattaatcccaccagtgagacacaaggaatgcttaattttggaagtgaagctacttcctcatccctgaggcagcacatacactttttcaataatcctttatttaacaagatccaagaatattaatatctaacagcttagcctaaatttcttgaaaggaccaagcccattgtgttgtctcctgacttgattttcccaaactgtcatggattttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttctgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaatacaaaaaaaaaaaaaaaaaaaattagccagacgtggtggcacatgcctgtaatcccagctactcaggaggctgaggcaggagaatcacttgaacctgggaggcggaggtggcagtgagccaagattgcgccactgcactccagcctgggtgacagagccagactccatctcaaaaaaagaaagaaagaaaaaaagaaagagagagagaaagagagagaaaggaaggaaggaaggagggaaggaaggaaggaaggagaaagaaggaaggaaggagaaagaaggaaggagaaagaaggaaggaaggagaaagaaggaaggaaggaaggaaggaaaaatattctttccatccattacacactgtaatgtaaaatgatgtgtcccagacaatggtctgtaaaccacattttgtaattccattgtaaaagataatgtagtgcgagcaaggccaaaaatccactattctttggaaaagtgtgccatttaattccactgaagataaggcagttggcacaagtcaacttttccccctggcttagatgtagttgtgcctttcaaaatgagctctctcatttgccaaatacaaagaagagaatagtgttttctcagaggaccacaggatatcaaacataattaaaaataaaagtaagattccctttgaatctagaagaaaactcacccaaatttcttgtaccaaatgaaggtatactgcagattttatcacagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctgtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttggccagatatatgtgattccatggttatcttatgtaagattggagtgcatgtcttgctagagtcttttacttccttattgactttgaggcaccaaggggccatattggggaaccccacatggcagcctccaactgagccaccaaagaagtgaattctgccaacaatctgaaggagcctgaaagcacagccttccctggttgagcctcaaatgagactgcagccctagccagtactttgattacagctttatgagatcctaagtaaagaaacaagcataactgagtcaggattcctaagccacataacccgtgagataataaatgtgtgttttaagtggctgtatttgttatacagaaataaaaaatgaacatacttactaaaaaagtttttagctgttgtgagtcctggtaattggatttgttttccagtgatatccatggacactgtgtcaatagtgatgattgatgctgatttgttttactcttatttattcaggatctgggtattaaaaataaattcaaactttcaacaggctgatcacctctgcccctctccctattagcatgtgcatgtgtgtgtgtgtccatgtgtccatacatgagtgaatggatgtgtatttaagcttaatcatgacacagggggttgtttatacagggtttttagaaaacaaaaacattgtctctatgaggcagttccttagaagccaactctcaacagtgtctcagtgtttccctcctgtaatttttccacacattatgcactggattttagtttgtgatactcaggattagtcatgaaaccaagtctttttgtgttctatggtttgaccagccctgtgcaagtctccagggaagcacgaaggacgggtaaatcagagtcccatcccttgaagcatggtggtattagaacatcacttaaagaacagggatacattacccatttagtgaaataatctagaagtcctggaaactaacttagctcacaagatgatattcattagccaatttacttcagaaactttaagaaaatcactttacctcctctgtacattcctccttccctccttccctctcttttcctctctccctccctccttccctcccttctttccttccttccccatattgttattaaatatgctcattattagaatagtatcaaagacactgaggcatttttagatatcttgtgaaatactccttatttttgtctcttcctttagatatcttaattatcaaaataatctaataagactctatttggaaataaagtgaaggagggtaaagttgtgtttttaaataggctgatcagtgctagaaataataggatagttttaaattctagcaattatagatcaaggctccatatactatttctaaaaagtctgtgaacccctgggaattgtgaatgtttcccattacatcctgccaacgattcttattaacctattggtgacgtctttcccagaggtgaagctttgatctgcttgtcatctcacattctgtctcaccacagtctagagcttccaggtccatggggaacaaggatggggcagcagcttccctgtgccaggactgactgggaaattccagaattctatgaccaggtacctgggaagggagaagagctctctgagttacagttagtctgggagcttttgaagtgaaactgtcatagggaaagtgaaggaatttgctttgtgcaatcatcatgccatagtctgacaagacaatggaaaaagaaagaaggaattttctctcaagatgtcaaataattagctgagtcatgaatgcaagcaggtaggcagaaaacagatatttgtagagaacttatttctctttctcctaatgaagtttttgaacaacaacgataaaatggaccttttgcctaagaagcaatttaacaaccattgcttcagtaacacgagaaccaatgtgattagagtgcttgtgctctgtcccctcataaatggttagtattgaggccttataaagaaatataacatctgctttttatacataaatacctacacgtaaccatccacaaataacttacgaatacccataataaacacagaatccatcattatgttaaatgccactgtgattctgagcattttaatatgctgtgaaggcatcagagtaaaacagaaacaagttatatctaaataggaatgcccagtacatttaaagtaatgagacgttttgctaaattcatatgttagcaatatgtcatgtggagtcatgaaggatcagaaataaaaaacagtaattgtccaagccgtcaaggagggatcagaagcaggctttgatcccaggctctgagtagagttgctgtggaattgtagattacatagaatacaggtggcatcaccacagattcctgtttatgtatttaacttgtaacttctcattctgacatcacaggaatatttttccttaacaaagtgaaataaaaagtaaataagctctttaatattgggacataaccaaatcagagggcaacacaaatttacatgggtacttgtgaggcaaaagaaagaaaattcaaaattcacttctaaaaatggacattgtttaaagcacatttaataagtgttacagagtgatgtttcactgtcacctttaaataccccttactgtttctttgggattaccaatttcaacatgaaggtccgagtgaactttgctagaggtgatttgcacaggctcatatgcatctcttcctcatattcagtgacctcacattagcagctttaaattggccatgttgagaacattgacaccacagaaattggcaaaaactagaaatcaagtaacacatgctacaagtctttttttttcttttctcccttcttggaaaattgtaatccagttgttaaatatttatcattataaagtagatccttgttaaaaatattctaatcctcaccaatggttttattttctttctgcctctcttctgctgcccctaaattaaagtaggtctttttatttggggctaagactagttccatcaaaatataaaatagatgaaaagtgttttggggcctttttgccctcttttcctagaccttttctgtttctcctcttgtcaaaatctcacttttttcctttaccttttcagccctgcttcagccctaggtcttcctaaaccagagaattttccaaaaactgcgtgaatatatatgccacaggctgaaatagtcttcccaaaaattagtcattaaaaaagtagagaaagaagatataagttttacatgaaaccctatatagataggagttccttcgagtattttcaaacttgattaacaacagagtaaattatttaagaatgatttaagaaatcaaagtatgagaacttggggctgatccaaagatgtggggattcagagatgaggggcaggcatagaagaggagaagagactgagtatttgtcaccacgtaaattcctgggcgagttgggtaaattttttattataagaaaacactcctttttcttctatataaaatttttttcaagtgagttgctaagttcattgtgagtcatgcattcctttgttcaagtgtggacaaatggtccttattttgttggaattttacactggcagagatcaatggtacaacctggtgaaccccccacaccaaagacacacaggtgtacttaaaggctgatcttctacagtacgcatctatggactggctttggggtgtgttcccaaacactcagagccaccttgagctggggaactggttagtacaagtctctttatgtgtcccttactctacaatcatgcacctagggtcgtgcaaacatcctgaaaccaacccaagctctaggagtcagaaaaggccctgaatgcatcttcaatacaggatctgtgcacacagcatggcctgcttctagaaaaccaatggggctcagaggcagtccagacagaggccttattttaagggctgatagaataggctgtgtttccccaacagcctaccttggtgagtaaacaccaacaattaattcatttatttactcactcaggttagaacattgtgttttcaagtttctaatattaaatttctttttcttttttctggaatagggactatcttattcagctcaaaataccatagactgaggcttaaacaaagacatttgtttcccaccattctggaggctggaagtccaaggtcagggtgccagcctgcatggcgagggttctggtgagaactttcttcttggcttgcagatggcagccttctccctgttcccttacttggcagagagacagagtgagccctggcatcttcctcttcttataaggatgctatattccatcatgggggcccaaccctcatgtgcttatttaaacctaattacttcccaaagaccccacctccaaatatcaacacattgggagttagggcttcaacccatgaattggtagaagggcgggaggtggacacaaacgttccatccataattctagctggtaacatcattgttagaatcagttgccttgccagtctcagaaaacaggacactgagatgcaaagacatgtacatttccatttgaggcaggtgccaggagacaactgagaggacactgagtttagaacattggatcaggcattgagagggaatctgggttgctggatgcaagaggctagtaaggggtgatgagagttcttcacataaatcaacctataactcacccagcctctgtgtcccaggggcctatccattattgatcaaaatgtcagtagaccttttgggttgtgtttcaaagagtaaccattatcttagagattcatagcaaaatatgagtggttcccagtaaaataaatcagagtttcctttatcttagctagaaacacctattgggacttttgtcaaattatttaggggaagaagaaggttgaaagcaaacttccaattgaaaagaagcatatttattgaagttcagagggctggagcgttgttttttgattgacaaaataatgaactctctgataagagtccagaattagttggctgaatttgtattcatttctccataaatttgccaaagttagaagagaaaatccatagaggccaaatgaagaaccatttgattaagcgtgttatcagcctggttgtggccaaattccacctcatatattcatgcacacattctttgctatgagttgcatatgtgctttgtggttgtgggcagatttaggtttgtttttctttctgagtcttttctggtccaaaagctcatcatttaaagttttggaagcaatttagaaagctattagattcccaaccccctcccgacttttggaacacttgcagttatttttttctggcacaaaaacaatcaaaaaggaaaaaaatgtcaggatatcttccaaagagagacataaaggtaacattttatttataccatgatttgtttattcttatttgttgttaccataaaagttatttaatttttttgaactgaaaggcagatgattttaggggataaaaaacctaaaataagaagtgttgctatgtgattacagagaatagttgcttttgttctgcctgtgtttaattaaagcaccatttgagaaattcaagaatcaggtggtaccgttgagtcactggacacatttttaagcaccatcttgaaatgtgatataaattgattttaaattttaaatttgtaatcatacacttcctctaaattgggaatcatgagagcatttctttttaagtagtttgtgataattttggaatttgaaagaaactttaaaggtaatgtatttaaagttactcacagaaatatgctggatgtgttgactggtaactttaaacatgtttatattgctatttttctagcacttgaaaagtaatcatgttttatagccaaagtcatctcctgtccatagaacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagacagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggcttcgtcctccacacaccaatgctttgtgtgaaaaggtttcattaaaattgagtttagggtaagtacgggataggtggagaaaagattttcttctaatgcttctccagaccacactgtttagccttcaggagacccaggaattgatatgagcaaaatgtttttacacatgaactgttctttaatcccttttttgcttcttcaatccttgaacttcattccctttcttttcattaacatttacaacacacactttacagggaaagaaagtgaaagatatgtaatgattctgcctgctacatctgactgtactccatttctcacattctatcctcatctttttctagccacctgagtcttcagacagttttaccatcttccctattttaaccccaatttaaacatccacaggaagccaaacaaaatatgcccatctgctccagatgtgtcaaatcaagttctgctattttaatttttttccaggcaaaccctccaacaaatgtataaacaggttgctttttagaagaagtaaagattaatgtctctctgggaaaaaaaaatcccatgcattttggaaagtctggctgttttccccttcaaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcgataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaaccacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatgggataagagtgatatttcagtgcatgtatacagtgtgtaatgatcaaatcagggtagttagcatatccttcactgtgaacatttatcatttcttcatgttgtgaacattcaaaatcctctcttctagccttctgaaaagataccccagagtattgttaaccatattcaccctacagtgccacagagcactagaattcattcaccctatctagctgtaactttgtatctattaaccaaactcttttcatctttcactctcccatacccctccctgcctctaatgactacaggtctatctctgtttctctgagttcaatttattttagcttctacatatgagtaagaacatgtggtatttgtctttctctggctggcttattttagttaacatgatgttcttcaagctgatccatgtttgctgcaaatggcagaatttcattcttttttacagctgaatagtattccattgtggatatgtaccacattttcttcatccatccatctattgatggacacttagattaaaggtactctgcttttactatgagtgaagtggaaattttttgaggcttttctttttatgagacaggatctcattctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagtggggaaataggatcagactcatttttagggagcccctctggctgctctgtgaaaatagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccacgtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgatgcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagggaaatattttattgtaagttcatcttacaataaaatttataagggaaagatattttattgtaagttcatctcaggacaagaaacttcacttggcatagaaattaacatccaatctgcagcctgtcattgtagtgagatagtcttgaattccctagctaagttatttacctaaacaaagtcttgttcactttgaatttcctagctaagttttttacctaaacaatcattatatatgtttcaaaatatttaaatttttcccttccctctgattttataattttcttgataaaccttcctaaatatctttaaatttcactgatctaatggttcttaaccaggggtgattttgccccccatcaagggatatttaacaatatctggtgacatttttaactatcgggagttgggggatgctactggtatgcagttggcagaggccggggatggttaagcattctgcatacctgggagggccttccataacagaggatcgttcattccaaaatgtcagtagtgccacatttgagaaaccctggccttctggtgaccacaaggccttcagctacagaaaataaaattcaccaaagatccccacagccatgctttgaaatccttcacagtttgcactgagccatgcttcccacaggctgctccaatgaaggggattactctgaaggccagctttggctcctggattctccaacatccgtgccaaacctttcttatgcagcacagtagcctcagacatttccagctcactcccacttttctctcaggacatttttcctataaaattcttgcacatttaatctcatttagaatctgtttctcagagatcctggattaatatatcatggcattaaatcattgaaaataatgaattaatgatctttcctcattgtagtgatatgggaagaaaacgttctgatacacagaacacagaaatggctcagaaatgagaaactgactgactactaaattgttagtaaaagcaacagaataagtaagtgaaaaatagagcaatttggggggaaaaaaagttgagaaaccccaatcttcaaaaaaaggataaaagtcttagcttttgttcatgtgttatttaaaacccaactcaggcctcaactgaaacaactaaaattaggaaccaaaattgcatcccctgcccattcacacttttggaaccagagtggttctggacatagtcatgaggtcatcattcctaattagagtaggaatttcaattcttgggtttctaacccaaatctcgctatcctcagaaagcttgacagtatttgcagctctgcccattagatgagatctaccctttgcctttggtcaggaagagtcctatgtatggacacatcaccacagaccactcagattccctcttaccttccctaggacactctgcctcccttcctcctttccatgatactcatcactctgggtagactctgcccaggcaacaattgccctctgtggtttgccaagacccatcctgctttctgggaatagatgagtccctctaaagatgggcatgtccccagccacccaccactgtgcaggtggcagctgacgtctattgtcctgcaactcacatatcctgatctctgctctgttatgaactccagccagagaaatatacagatcttattcctgattcataagagactgtgtttgccttggatttaaccaggtctgatgactttcaggatttattatgttgatgaataaagggaaattctctcccttaaactaacacaatgatctctctgaatcagattctccctatacgcagccagcaatactagagaagccccagagacgctgctacttgagggctggcctaccgcagagctggcgtttatgttgtgatgataaacattcttgaaaaaaccctgaaggagatcctggcattttcctagtgcctttatgtgccataccgagtgcaagctgcttttcatgtactaactaatttaattcctgcaagagtcctgtggcatgggtatttcttattcccattttactgacaaggacactgaggctcaaaaagttgtttttttgttttgttttgtttttgagacggagtctcactctgtcgccaggctggagtgcagtggtgtgatctcagctcactgcaacctcagactctctggttcaagcaattctcctgcctcagcctcccaagtagctgggattacaggcacgtgccaccacatccagctgatttttatatttttagtagagatggggtttcactatgttggccagaatggtctcgatctcctgatctcatgatccacccaccttggcctccgaaagtgctgggattacaggcgtgagccaccacgcccggccaaggctcagaaagtttaagtgacttgcccaatatcacaatgttagtaagtggtagaggtataatttggattttatttgaattggaaaaggctgtgatctttctaggtgatattctaggtaacactagtttccagcaggcactctccattacctgcgtctgttaggtctgagtctgctatggttttctgactgatgtgtagggtaacacaattaaggaactctccactggaaggccaagtctccactcaggcacgtaggtagctggcagtcctccttgattctgctagccagagccagcttattgaaaacaaaagcagtctgttaggacagtgcccagacttctgacttcactacggaggctaggaaccaagtcaatatcatcagtcattactttccatcaacctctatcatttacatgcagtaggtgctcagtaaatgctgataaattcctgtatgaataataaatgaatgaacaaacaagagcatttgtctgtacaagttacagagttttagaatagaatgtaagtgtgaagctcgataaattcaaacttctgcaatatccccaccaagtggttatctaaattccgtttgacttcccttggcagggaatacgcacgcacactttctaaaggagtttttccacttcatatgactctggctgttcagaaggaatcactaattaaatgagatctttgaaaaaagtcaagaaactggaaataagtaggaattgctttacctgatgcttatcagcttacaggctttactgctccaaaaatttggttcgatttgaaaacattatgctaagtgaaataagccacacacaaaagggcaattattgtatgattccttttatatgaggtacctagaataggcaaattcatagagagagaaactagaatggagattcccaggggccgtagagggagagtagttattgctgaatgtgtttggggtttcagtatgtggtgaaaaattctggatacagatgctcacatgtcattgtgggtgtctttcatgcaactgaattaggttttttttttgtttttttttttttttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtctcgatctcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttcctttttttttttgagacagaatctcgctctgtcgctcaggctggggtgcagtggtgcgatctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaagtacttggattacagccacgagccatggcacccggctggtagtttttcttcctcatcctcctcccaacctccaacctcaagtagcctccccccaacagtgtctattgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacactgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaatgtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttccactctgaatatgaagggtatatcatttccctctcaaatccagactcctctagttgaatggctgacagccaacagaaggggtgtatgcacccttcattaggccagatttactgtccgccttccatgagtggttcagcatgctctctgtccagctgtggctcctgcctgcaaagcgtgccatcagcttcctggttcagagagagctaattttctctaattgcttccaatgagaggtgggaggcaggagggtatgtgccccattcagagccgctgttctcatcagcctcaccaagcagtgagagcagctttcacattcaaggtcttctttccattatttgggtaaaaatgttttgtctcataacctgggatttaagaatcttcaacaggttgcttaacccttaaagatctgacccacctggcctttaatagatttaaagactttatttggttttatgatttttaaaggaatcataattcctacttatttaagaactttaattcctatataagaataatttattctcattcatacttgtaaaaaaagtgtatccattgttttagaaaaggggaaaatagaagacaggttaaaaaagaaaactaaaaggcatttggtgttgcttagatgtacatgttttgtagtatatatatgtggttttgatcataaataatgtatcaaagacatataataccaatttctgttcttttttctgaaatcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgatatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatatatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccattggatgcttagaaaaaattccatcacagaatatctgtgtcttgtcttcttgggggctaggagatcccccaaatttttctcttctgttcttgtttgataaaggatgtgtggaggacctggtgcttaagagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaataccccaccttttatatctgatcaatttcctcaatccccacctgtaatgtataagcccttgacctgccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttccttccttccttccttccttccttccttctttctttccacagaatctcgctctgtcacccaggctagagtgcagcggtataatcaaggctcacagcagcctcggccttccaggctcaagtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatgagccactgcacccagcctcacaattttttctttaacaatgcccagagcatatgctgagcttcccgtcactctctggggcggaatggaatattacacaactggcacggtaaagaatgcacttggttttggtggtggataacattttcctttgcacctgaagcacttccacaaatagcccatttgtcctccttgcaattaaattagaaaaactgtctctaagcttggtttgacctatctgtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagaggtggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaagggacttgaccaagtttttgcagctattgctggtagaccaagtacggaaatacacttctcttgactctcagtctagtgctcctttccctgcagtactctgtgcaataccaaaagatatggatctccaggattggctgaggttagcaattaatatggtatttttagtcatgtctacttggagtagggggtgctgatttttgtttcatgtgtgttcttgagactttttgatgaggttccgtatgcctcactctaggtgatgtttttattagtaccatgttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttgggatgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggcatcttcaatatttacattggcccgttgagttttatcagctggatattgctataaaacacatcacctgaaaattaagtggtttgaaataatgagtatttgtagttgttcacaaacctgtgggtcagctgggcggtgctgcagatctgaaccaggtgtggctgatcttgaatgggctctttcctgctgcggaaggcagccagcaaggtaggtgggggctgatggtcagggatggcctcactcctatgttttcccattggctgactatcagccagggctgcagtgatgactggtgaaatagtttggatatttgtccactctaaatctcatgatgaaacttgatccctacagttataggtggggcttaataggaggtgtgtgggtcatgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggctcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctgaaaacaaaacaaaacaaaacaaaaaaaacctccatgcttcttgtatagcctgtagaactatgagccaaataaacttattttctttataaattgccctgccacaggtatttcttcataacaacgcaaatgaactaagacaacaagtctctgtgttctccttcatctatcatactacccgaggtttgtttacgtggtaaagacaaggttcggagagaaatggttgaaaccagcatagcttcttgagacacaatgacacttatgccacatgctattggccagagcaagtcacagaacatctggattcaagaggagggaaatggattccacaccttgatggaggagatgcaaagtcatatcacttgggacatggatacagggaggggtgcaatttgggatgtttttgcaattaacctaccacaggcttaaggaggcttttaggatttaccttctgctctaatgagtttcaaccaccatggcttagagaacatttcttaaaactcagtcatctttcatgtatccattgttctccaaagggactaagttttgttccatggtcagtcttttccatgtgttcttggaccttatacaaaacccaagcctggaattacagcacctggatttattcatcaagcattcgccagttcctggttctatgcatgtgttcacaaaactcagaacagggcattcctctgaatagagaagaaaaatagagtcagtcagaaaagaaattttttgtctaagaatacaatccaccgtactaccaccagacttggttccctttcaatgtcgagagtaacacattccttttatgtgttgcttaatttgcttgttttaagcagttccttgtttttggagtgtcttttttgataacattgagataccacatccactgatcatgtctaaaagctgacaatttctgaaggaaataaactgttcaaaattaactactctctcactatatatatagcattgtattttcagtacacatttttggtacacatattcgtggtacatattttccagctggcttgtgctaatgtactagtgattagaaccaagactaagaaaaaagtgcattgccattttcaatcaacgtgggtagagctgaatggttgattccaaatcaagttattttgcctaaagcaagacagataggagagagagagagagagagataatacagagatagataatcacaaactgccatttagagaaaatcattactactatcaattataagagtgattagcaagtttatggatagcatgatggctagcaatctttatacaaatgtggctgattttcactaagtcttttaattctcagaattgtttcatgacttttttggagaaaattgttgaggcatgaaaagaatttcatgactgagatagatattgtaccttaggaaatataaaatttaacaaatctgtagaaaaggaagacttaggctttgactttaaaagcccattccacttacaagatttcattttttgtttattcaatttggaaagcacattttcttatataatcaataagaagatttttatggcatgctcgagtgtagtctgattccaggtctcataattcctttgcactcaaaaaaggaactttgttacatcttgccactcatgctcactcttcagtgggcaaagtgactttgccatactgtcaccatccttgagccactgcccggtccttgaaaactaggattcttcatttccttttgcatcgtcagcgtgaggaaggggagggggaggtaagattctggacagctggactgaaaacaatggaaaatccctagtaacagcttgaatcactcactagcaggaggaaaatgtgactcgtttcttttcctctttagcttttgttgatttttttcataatgagctcagaaagagggaaagatcaatattcatgttgagttggtatccatcatagtgatattcagtgattataactctccaattctcactaggacaaatataaccacgcaaactggctaactgcacttgctggcatggttcctttggaaactcctggatttctctgaattacaaacagaaggagagttatagattttgtctctttaattttctgtctcttgaaatctcagatcacaaaaattgagtctttcttaactggtgatttcttattcgtcaatgactccttaaaagatatgcagaaagtaatggccctctaacccttcacctttgtaagctctttaatcctgaggggatggacttcctgatttctgttctctcagattctaaggaggaaaagactagctgttgtctctcaagtctacctattgctgtcctacagagcaaggacccctcttgttctccagctcctcaggaataggattcttggttccctaactctaaaataggagctcacaaggttattgtcaaggacaaatgagggcagtgttaacgtattaaaaaaaaaaaactagtcagagattgcttgattttcaaacttgatagtatgctttcgaagttacataatcaaaattatagttgtatttaaaatgttaagttcagcttacaaaccttcttaacctatttgtaagtcaagcaaattttaaaaatccttcttaagggaagcttgattaatgatttcttctcattttcaaatgtagttaaacatttttaaacacttaaagcttgatttgtaaatttaatacatttaattttaagtactttagcttgtctaacttaacaaatgagatactcatgaatatttgaatagctcatcaattagatacttataaatatgaaatatagtttttaagttcttttaaagttctcaatgtacttgtaaacttgtaaggatttcaggtcaaaacgataagtttaaatcatttactcgatttaacattttaaattggaagcacaattctaattcactattattttaataggccaaaatatcttaaaattacaagtatataaaatatcagggccaggcacagtggctcatgcctgtaatctcagtgcttttggaggtgaagccaggagaatcactcaaagccaggagtttgagcccagcctgagcaacacaggaggaccctgtctctacaaaaaatacagaaattagccagaggtggtggcatgcacctgtagtcctagctatttgggaggctaaggcagaaggataccttgagcccaggagtttggggctgcagtgagctgtgatcacaccactgctctccagcttgggtgatacatcaaaactctgtgtctataaagataataaaataaaaatatgactaatgcaaaattatttgatactatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagttgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccacagaagcccaaaactcccatcctcatagtcatatcaatggattagattttattatatttgctgcaaactctttttataatgttcttcctactcaccttattcttatgtctattctattgagatctaattaaattatgaatgtctcttaagactctatctggctttatagtgacaacatcaaaggatatttgtattagttagggttctgcagagacacaggatgtgtgtgtgtgtgtgtgtgcatgcatttgtgtgtgtgtacacaagtcccaagatgtacaggttatgttggcaagccaggagaaccaatggtgtagttcccgtatgaaagccagcaggctccatacccaggaagagctgacatttcagttccagtccaaagtcaggaaaaagccaatgtcccagtttgaatacaatcaggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacatacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaaaaagtccttgtacaaatttttatccactttttttttttttttttttttttgagacagagtctcgctgtgttgcccatgctggagtgcagtggcaagatctcggctcactgcaacctccacctcctgggttcaagtgattcccctgcctcagccttcctctcaagtagctaggactacaggtgcacaccaccactcccggctaatttgttcgtatttttagtagaaatggggtttcaccatgttggccaggctggtcttgagctcctgacctcaagtgatctgctggcctctgcctcccatagtgctgagattattgctatccactcttgatactgtttggcatgtgacttaaaacaagcaacagttgaaaatataaactagaaaatgagcatatatgttcattgttgctaaaggcttggtaccagcaccagctacaggagtttatagcataccttctcagagaaaggcctcttcattctgggtttagaggtgttggtatcctctgttgcaagatgttattcaatcaattcaatcctgagttttcaacatcagcaacattacatgtgcatttacaggaagaagaccagagtaggaacactttcattttttcccccaaccatctacaaaaatgaagattacctgaaatgtttactttatactatgatcttaaaactatttattttaataatatctatataacccagatcaagaaaaccagtgaaaattagcctattcaatcctttcaaaaggcttttttattccaaaagattgaataaaattagttactccctttatcctgaatttcactacaaatattacatttgcaaatgtcccatctgactgtaataaatgccagtgactttaactctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctctctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagacactaacattcagaaacaataaaatagagacagtgtaaaaggctaaaaatgggctgggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaacctgggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatccccagaggaggagcttaatctaaattatgaatgtagtaaatgcaatcacatgggttcttctaagagagacagggggtgttttgagatagacacacagggaaggcaatgcaaaaatggagcagaaggggttatagctaaaaggaatgccaagggccaccagagctgtgagaggcaaggaacagatttttccctggagcctccggaggaagcaggccatgctgacacattgattttgtccttctggcccccagatctaagaatatatttctgttgtgttaagccagcaggtttgtagccatttagcagccacagaatactaatatggacaatgatttctgagaaaataaaaagattattttgagaaaataacaacattccttgtttgatttttaggaaaagccattttattttaatttttttctatttttttatttttattttttacattgaggttctctttattttttactatttcttttttcttttcttcttctttttttttttttttttttgagatggagtttcactctgtcgcccaggctggagagcaatggtgctatctcagctcactgcaacatctgcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagctacagtgcacagcctatttctgactatttcttgacggccatccatgctgggggaacaccctcatgtgcctgtcaagcccaaatcccactctaaaaattcagattcccttttctgactccgtaggatgcctgtccacggaggtctcataaatccccaagcccacattttccccaagtcctccccctgctggttacctttcctttcccactcacatggagcaggtgtccgaaacaatgggttttgggcagaaaacgcattttagtcaactgttgtataaatattctaaactagtaattaagattttaagcatgtgctctggctggtcatggtggtcagattgcaaacagttggcaatcttatttcagcagtagactagaatctggtcataatttatccaagggaaaaaagacttgtcattaaattctctccaacggtcctaaaattttaatttatccacgcctaccttgtccattactgttttaaaacagctttttaaacgtctagattccagccctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctcaaaacatatctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggggaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttggggggctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatcagttactcaagtcaaaatgccaggaaagtatatgaataggtagcaacaaggtattgggttgaaaagaaaatgcttggctggctcttagatggcttgccctttagttgctactttccttggaccctttccagggtctccaagcatgaaggacccatctctcaggaagaagtccttgcccagggctgtttatcttagttgagtacagccaagtacaaaccagagcgaagttgggtcttgatctcctattgggtgccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttgcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaatccttttcaacttaaagttgaggtgatactgaatcaaggcctggcagaactgactacagactcagagggagtatgtttattgcttttaattcttcctatttctgtttgaactaacatggcaaaggctttcatcttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagctactcgaaaggctgaggcaggagaatcgcttgaacccaggaggcggaggttgcagtgagccgagactgcaccattgcactccatcctgggcaacaagagcgaaactcagtctcaaaaaaaaaaaaaaaagaaaagaaaagaaaaagatcgggtgcgggggctcacgcctgtaatcccagcactttgggaggccaaggcgggcggatcatgaggtcaagagatcaagaacatcctgaccaacattgtgaaaccccgtctctactaaaaacacaaaaattagctggggatggtggcatgtacctgtagtcccagctactcaggaggctgaggcaggagaattgcttgaaccagggagtcagaggttgcagtgagccaagatggtgccaatgcactccagcctggggacaaagttagactctatctcaaaaaaaaaaaaaaaaaaaaaaagaaagaaataaaaagcaaatactaccaaattcttacctaccagagttacgactgctataacccttaacatttaaacaagggaaatcatcatttgggaattgtatttcctcttcatacaaactagtcttccatggtaatagattggctggatgtttttccagtatgttttctagataaatagtccttggagccattgtttccctaagaattaccaaaaaaataaaaacagaaagcaaaaacatgtttgctttctgctggaacatacatctcaggcagtgccgaggactaaagataaatttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaaataataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattagagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcattgttctcccccacaccttctctaccatcagatttcacccagaaccctcatgtgccacagaacttcaagtaaataccagccctggaatactagtcagaaagctgaaaaaaacgtgcaatatgagtttgaacactctgagatcgttaacacttttttcaataaggttagataactaagatgataaataaaaatattttaaaacattaataaagaggaaatgattctcatagaattagtatagccaaattttatcttcttaattgttgtatttcatcaagagacatagataggattaattttggttttctactataactgcttccatcagggaaaatagattaatttctaaaataccaccagaatcttagagttgtttatccaagaatctctaaagacactttacattgcagagtaagtcaataacatgggcaaatataaagctagggaacatgtgaaaaataaaattatgagttacaaacattaaacattatttcagtagaaacagattggtggctgcagttgattattaaagaatgccattaagttgtcaggaataactgttgtagttttctgaaaatagtcattttgttgtagctttagattggattagctagagctatacacacgagagatgcacatcaggccttagacacaaattccttcaggaaaatgattcactggctatttagggggttgacagccagtatatgttgttttcgagtcacagagaaaattgtatggttgtatattctgctttaatttacatcaatggaagatgagctacaaagcagctattgatacaaaaggcaaacccattgtagaaaatgaacattttctgtaagctacatctacattcttcctgatcagaaaataatacagaaagtgacatacttgttcctttttcacatttgaagaaaatgttacaaatgcctccatgatgcaattctgtatttagacaatctaagcattgagtcttgggatacttattctgtaactattttctaagaataacctgaatagaaaacatggaatttggtagtaaaagatataaataatgaaaataggggtagggtcctgtgcctcagtgaagtttaaaatttaattgaacttctaaataaatgtttaaaaatagagcagtttcaaaaatacaaaagctagaatattcatagacccctgaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttgccctaaaatataattgcaatattgaatatctctaatagatctcaagggccctctattagtccattttcgtgctgctgataaagacatacccaagactggacaatttacaaaagaaagaggtttattggagttacagttccacacggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgtacttccagtttcgtcatgttatggtcttgggggtgcaggaattcccaggtttccttgaggtgaaatctgaaagctgagaaatatagcacagctcacaaggaagaagtggataaaacagtgtcctcagagcagccagggaatcctaacccctgacgatcttcagtgaggcatttggtactccaacctgttgtgccttagccctgagccccagtctgtgaggtgcatatggtcctagctaataggtcagtgggaaaagggagaaataataaacgaggctgtgtgtaaacttacgtgtaggaaacaggttaagctgttctgccctgttgcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctctgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtctccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggagctacagaacatgcttggaagcacgactttttatttagatcagatgattgttctttgacattaagttagctcattggcaatttcatgatttcttgtgcatatcccaaaatgaaatgacacctgttaaagtgccagcaccgttagcaaaagaacatttaaaacagaaagtggtgccagttttatttcaatgtcatcagatgttccaaacagaaaatcactccagttaattcttgtaatggtttcgttttctcatccaattccgaggaagaaactaaagctttttgaaattaattctgttgaatgtattattcatactattttaaattcagttaatatttagcctacatttctagcatttgtctaatattaacacagtttttggtggagtactgcatcatgaagaaacctaacactctgaaatttaaagatacgaaatttacttggaaatagtttttatgtacatataattcatacttacatccaaataaatgttgatagtctctcaattaaaataaaagctgtaagtttcaaatttttgaaataggtacatatacaattggatcatctgaactgtgaaattttgttaggaaggtaatgttgactacaaaaaaaactcagaatatcaggattcactttttctctctgctgcctttcttcggttggattttagaaacgttcatgagtgtttaatcttctgtgcttttaaaattcttctgagtgtcttaaaatagtactgaagttttcatgacagtcttttcatttttggctgaatattgttttaaaatcatctagaaatctttcatcaaagtaccagtgaatggaacagcaaaagctaaagatttcaaagcttttatcaaaatgcgattttcgcaaacaaattatgaaaataggaaggcatggatatgtatctgcaaaggcaagggagaaactaaagaattgtagaataaagctcaaatattataaaatatgtaatttgaaaactccaattgtgttttgaaatattcagtttgtgggaataatagtttgatgaagtttcaatttttaattaaataaatttatatagagcagatataatgaaattgaagacttagtaaaactttcaaaaaaatcctaaagacagtttatttgatgatttttgacttttaaatatttgttaatgaaaagtattcttagtaaaaaaaatataaaatatttgggctgaaatatttaatataaataattgaattgaaaatattttctgtttagcacaagctctgagcttgttaagtaccttgtgcctgtgggagaagctagtctttaaaagtttaaatattggccaggtgtggttgtctcacacctgtaatcccaggcgtgattaatttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactgcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtatttttttaaatacttttcttagaaaaatactagtgatatactattaaagacagataaaactttaaaaaattgattaaagtacttgcattctacttattttaatgttcagattgattttatgaagaatttttgcgttagtgaatgaagctttgtgttattttatattttagaaataattctagcatagcatagaatattttataggtatacgaatataataaaaccagaatgttgttcaccagacgaattcttcaaaaaaaaatacaatcttcacttttagtctactttcttactctcaaaagtatcctaattagtctagtgctgaagagtttcaaactcatttaaagagaagtagacaaataagtgacaggaaggattgccgtgtgtatcttccagtctggggtgatgtttaaattcctcagagtccacttagctttgtctcttcaccagccttggtttgccccagtgctgttcatcattttaacaaaaatagatctcacaggatgttcacccagtcacctttttgtagggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggttctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgtgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaagttaattaaatcagaactttcttcttgagtttgatccattatagtgagttaccagctgggtatcaactgctttcccagaaaggccccattgaaattaatggactcagggctttgttgagtctggacactagagaattggacaaatgacactgtggtttattaaagaattatgactgcaaatacattatatgatgctttctccctctctctccatttaattatgaatctgcctctcaaaagccttgactctgtattttaaagttgacataaatggtaggacgaggttactttttccagtaatggagaaaggaggagaaaggttgctccgaattttgtgatcttgttcattttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataatgggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaaggaaaccactctatggaaataacgtctaaaggagaccctctttatcccggagaggaaaaccagagagcagtcacaatctggctaacataaaaagaaccactccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttagaatgctgcaacttaaaaccaattgattttaaataaaaatggtaacattataaagtgtgaaagtgtggggttaggaatcatttcccaccctgtgaaaatggctctatggtcacccaggggtttgtgtgtgtgtgtgtgtgtgtgtgtgtgtgtgtgtgtgtttgtgtgtttaacctgtgagataagaatggtcaaccagttgactcctcaagaacagtctagattgctacaggcatgaagttgctttgagagcaggttgaatgcccacacatgtaggtttggtagaggtggtggtgaaagcggtgagcatggctgcagggtactcatgccactcactcctttttgttacctctcacaacctctctctgtctccatctgacatgcctccctagactgtctctaataccattagaaacttcagcgcaaattgtgcaacctctccgacactgaccacaaaccctttccagcctcagaaatgttcatagatagatgagggttatcagggttgctcagccagtgaactccgaccacgctgggtgaggctacatttgtaatctgttctggaaaacgggaaccatgctccattttcaacctgcactcacccactcctatttctttctagggtgtctctgtttttttgcttttaaccttgggtttgactttttccagtggacatttctaactaggaaacttgatggtttccacttagattcccttattctccaacttaataaacatcaatacatttagaatccttcgctttccaagactctaactgatttgtggccacagtgatctttaaaattcattagactttcgtcattccattttctttattaaggcatccatatgagctgccatgtgtttgctctctttcatatatctgaatttactgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctctctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaaagaccaattaaaaaagggggaaaattggtgctacaatgtcactttgcgggagaatgatgtctgtaaagtgggagcctatgtcttgcaatatgctgatgccctggttgaatagaccaaactattcattccttcctctatggcctggggagatctctctccatcacacctcagtgaagacagctttgatgcatttgactgtggtgccttgggcctcccagttttcaatttttatttgtttttttctggtggctgccttcttgactgctgatgtgtagcttatgaaggagtgaaggatgtgccatcccaaaatatggcagattggtatattgagtatttcaagttgaaaacattggagacagtgtagtttcagaaaaggaagtctgacctgtctcttcctgcatgtagcacaccataaagattcctctgggaggggtacccttgccttaccagggcgagaaaatagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgtctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccctattgttttttttctttaaataccttttccaacaactcgaagctcagcagtatggtggacttcctcccttgtgcatagatattgttgcatcatttctgtcttccagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagttctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaataggaggaggggaaaaaggacaagcagcttgttgctaatgccctcaaacaaggcaaacattttgtgaataatttttagataatatatgacggtttggatctttggttttgttgttttgaatggaatgcatagaaaaaagaacttgtttcaacaaaagtttgatctgatatcctattcatgggctgattctttctcaaatatttggcagctcatccagggcacagaaaaggcacagtgttgaatcatgttgctttcaagctctgtatcagtggaaggcactggaagggattatcgatcccacaaaatacacaaggaaagtatgtgcccacttcatttctgaggaaatttagggttcagatggaccttgccatagactcagtgtctttagtagaggccaaataaataaataagccaacatagatgccaggcaacttaccatacagcatgctgaatttcttccctcatgtctggtgactggttttatagaacccattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcttcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcattattcctcttccatgttcatagatcaccctgggtattactctgtgctagcactttccttctttctgctatgtagtaccagtcaggcactcaggggaaacgactatgccattcactcattcagtcattcattcattcattcaacaaagacgtattggattactattatgttccaggcactgttttagggactgaagataaggtggtgaacaagacagataagattcctgttgtacaggagtatgcattctggcagggggatagattaaaagggaaatcaataagctaacacgttaagtgctaccgataagatgaaaatatgtcaatgggaagaagagtgcctgctgatttagactgggtggtcaggcaaagctttgccaaagagatggctgaagctgagagttcaaatgcaagaaggagtctatgaggatctgggcacggagtgtctgagttggaggaaatgcaagcacaaggccctagaggaagaatgagaactgtgagctcaaaaacctagaataagccatgtgactagtgaacagcatgtcccagcaaaagtcacacttagaaaatatagggcctgagggtcacaggaaaagttgtttattctttacctgatgggaaaccttgggacaattctaagcagggagttggaagacgtgatttatattttgcagaaatcaccaaggctctgcatgctgaatagattttttctttgcatccccagaacctagcacaatgcctgcctctgtttcagtagggcccagagccgtgctgcttttccacacaggaaaattgccttttccaaggtgcatggctgcccagtagagaggaaagctcaaagtcatatcaattcaacacgcagtactaagtctctcctcttgctccattttctactggcctgtgaccaactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacacgatgaagtggagccctacattcattatttgaccttgtttgtttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttttagtagagacgggatttcactatgttggccaggatggtctgaaactccggacctcaagtgctccacctgcctcggcctcccaaagtgctgggattacaggcatgagccaccatgcctagccctgtgactttttctcaagggcttcaaacagtccctctgcaagttaacctaggcatactcacagagcaagaaggcattcatgataccacaagggaggtgaggtttgtgccatttgctccatgtcactgaggcaggacagccctgtgtggctccattcccacgagagaccgtcttgctccgttaggactgcctcccacctgctaagggtgcttttcttccatggtacagtgatctttaatcatttgtttcaaaaatgtaccaacctcccgggaatgaaactaaccaaacttccctccctccctctctccttcccttccttccttccttccttccttccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagccgcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatggaatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgccgaagtgtcttaatcttttgaaaaaaattatctcaaatttacattcacaaggagccatgtcttttgccactaactgaaactcagtaacaacactgaagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaacatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacattctttctaaacaagcagacactacttttggcacctcccaatgctggccaggtcatgttaactacccttaatcagctttttttcttgcaatatttgtaatatgcatcatctcagggcaagagacaaattagatcatttgaagattaataaatccttacctctgtttggttgcacttagccagcaaattcatcacatgcttagtctttgctttattctgggccatgtagactagctgttaagtggaaaaaaaaaaaattcttcttcggggcagagtggcaggatggctctttggaaagagtcttggagcaggagtcaaatggtctggctttacaccccagctatgcttacaaaagctgggtaacttgcagttcccttaccactaaagtggaaacatggatgtctaaagcttttttacagctagaaaagtctatgcttggttagcattgtgctgatgcaattctgttccagataaccgagggagggaatggcggtcctcgcgtgaagactaagtagacgtgctattaccctcctcggttggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagacgaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgttctcagcctcggagcttctgctccctctgttaggggtgactgattctcaccaccaccaggctaattctgactgttctggtttcaccgcggatgtcacctcctccaagaagctcttctcgactttctgcctgcagaccctcatctaagctttcacaacaccctgtgttctgtgtttacacccacccaactttttcttttttaaattttattttaagttctgggatacatgtgcaggacgtgcaggtttgttacataggtaaacgtgtgccatggtgttttgctgcccctatcaacccttcacctagatattaagccccacacgcattagctgtttgtcatagtgctctccctctgcccacccccctgacaggtcctggtgtgtgttgttcccctccctgtgtccatgtgttctcattgttcagctcccacttatgagtgagaacatgctgagtttggttttctgttccttatgttagtttgctgaggatggtggcttccagcttcatccatgcaaagcactggatatcattcctttttatggctacatagtattctatggtatatatgtaccacattgtctatccagtctatcattaatgggcatttgggttggttccatgtctttgctattgtgaatagtgctgcaataaacatatgcacactcaccgaactttgcttcactgtctatcagaaaactgccagtttttcagttgcatttatctcctagaatataaaggctttgaatagatccaatggtcttgtttaccattgaatctgatacctaacatggaatctgacacctgctagacaccctcagaatgtctgtgaaatgatgtaactctacgtgatgtgtgtctactcatagctgtaaaatgagtgagccctcctgtaggtcacagtgtccagcagactggcagggacctgatatgaacatcacagaggaaaaaaacacatacgaaacaattaatgcttgccattgggccaaatgctttgtatgtgttatttcatttatatttttatttaatactaagcagacttcatgtaccctgtattttgctaggcagtggagtacatagaaaggaacagaaactgcgtatcttgtcttcccaactgaaaggagacgattaacctacttgaagatgttagaatacaaatacatgatatctgaggacagggtgaagaaaaacaaacaaataagaacatgaaaaactgtgtttgtcttgactattcaggatatgaaagtgccgcaacattcatgtatctagaaactccatgaaggaatctacacttagggcttaaagaatcctaagggaccgggcgcggtggctcacgcctgtaatcccaacacattgggaggccgaggtgggcagatcaggaagtccagagatcaagaccattctggccaacatggtgaaaccccatctctactaaaaatacaaaaattagctgggcttggtggcgcatgcctgtagtcccagctactcgggaggctgaggcaggagaatcgcttgaacctgggaggcggagggtgcagtgagccaagatcgtgccactgcactccagactggtgacagagggagactccatcaaaaaaaaaaaaaaaaaaagaatcctaaggattcctggttcctgacaggtgcttgttccttgaagtatacttgtgccgggaagcaaatcttctctctctcgttttgaacttggaggagacagcagctcccttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcctctggcctgagttagggaaattatatattgtttgtccaaagtagtaaactctgtctaaaatgaaactctagactagatattattttttgatgttagatgtatacgttctctccatgatttagcagactttccagggaatgatgagtctcccctctactgaatactataaacatgttatctcagtgggaaaaatagaaagagatccagagaagaagagggaacatcttgcttttgaagcatctctgcttacgagtccataggaaataaattacatttcccagggttctgatttggtttttaataacttactggccctgctaaacaagacactcaggagaaagtgcatgtgaatagatggagatctacatttttagaaaatatgtttctttcttttgggatcacaatcagaacataggcatcattgaaacaaagccgaggaagaagaattttctcatgctatgcagaagttttctgttaaagatatcagaggctttgcaccctgagagctgtaatcttctctccttgagttcttcattgagatttactgcagaggcctcagatgtgtttatttctattatccagttgctcctaatattacttgcaattgttttggcatgagggttagaaattgcaagaactcctagctcgaaatcacagaacgtacacaaagacaaaacagaaataaagcagaacaaatgcaaggataaaatagataaaaatatctccccaccctaattgtgctcttttaaaggaatgctattgaaatgacaaatgaaggagatttctacctgttgttatatagctgggcagagtgacatttttggctgtattctagtgttgagcagttgcaaagctttctttccccctgaagcagtagagggtgctatgtggatataattgaagagatgctaagtttctatatgacgccagggcttagggactgccctctcttttcaagccacttgcttttcccaaaataactaagaaaagggagaaaaaaaatgagtacagaggccatgctagaagacatagataaaatattaagtcttaagaaaggtaggaaataatcagattctaaagttctcacaaggtttggtattttgaagtatttggcagaaggcaagggtatggaaaactttaagaaattgtaagcttaggactttatcgtaagcttaagacagagatgttatctgtctgaaaacagagggaaaattttgaacagagtgattcttgtaataagagaagacttttgacaagttatgaattccttgaatttcattattttttcttgctgtttaagtagtatatattgtatatttgatgacagtcagattttactgatagagatttgaaatatattttgatagggctacctcatgctttttgtagaatcaaacattttagagctgttcagccccttggagccattaagtacaatcttaatgtttttgcataaggagacattggcaccaagaagttaagtgacttaacctgtaacaggctggtccaaacatccgagcctcaactagaaccagtgtccttacccctggtccaaagctctctgtcttttgctaccctgctttgagttacagcattttatatgctgacaatacataatcctaatacatttatatattgttttcacttacaaagcagtttatgtacatttttccacacttatgtaccaaaacgtcctttgaaaatatgttatttgttgatttactcaaagaagacttgcccagttttatgacaggctgagaagttaagtctcctgttgcaattccgtttgcaattcagtatccattacacctggtcaatcaagtttcttattaatcccacgttttccctgcctgtaaactcccttcttagtgaccgattttgctattttgtgtgagcacttgagtaaaattcaactgactcagagtagggaatcctggctggattaatgggattgtgtaacaccttcatcacttgaggcccagataggagtgactgtgcgatgtaaaaaaggcttgccaacaccactgatgtttgacgtgaaggtgaaaagttcagtggcccagagaagtgctttaagggttcttcttaaatctaacacctgaggaacaccttcagattatccagcagttgtgatcccctatgcagtgtctatttgtctagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggagaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggatttttttaaattaaaaggagtaccactttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcacactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgaacccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattgtaggtacttcatggatatctgcctcttccttccatgtgcaaaaggaattctggcatcatcttttataattactaggaattttttactgccttcagaaaatatttctagacttatcctgctaatttttgtttagaagttagcctctgtttcagtccattctctcattgctataaagaactacctgagactgggtaatttatagagaaaagaggtttaattggctcgtggttctacaagttgtactagaagcatggctggaaaggcctcaggaagcttacaatcatggcagaaggtgaagaggaagaagagaagtctcaaatgactgaagcaagaggaagagagcaataggggaggtgctacacacttttaaacaaccagatctcaggagaactcactcactatcacaagaaaagcaaggggaaatctgcccccatggttcaatcacctcccacagggcccctcctccaacactggggattacaattcgacctgagatttgggtggggacacaaatccaaaccatacagtccctgaatatatatgtgcagaaatagactgctcacctagacttcaaaagacatgtcatcattacgcacctctgagacattgtatggtcttggttttaaatttcttgagtaatctggttaattctgatactagcgatcaacagctttggtgtaaaggtaggtcagattggtgatatattgctacagcaatttgaggaaatcaatttcctccctaaaagttttgacaatcttgtttatttatatattttatggtggtgaggggagaaattattcttgagatcttgcttctttgaaatatggttcttctcaggaatatcctatgttattagatgatctaaaacactgtggcacttcttaaataaccaatacttaagataccatgaaaattacaacccccgtgagatatagtatcaattaaactatgccatatacctcgattggttgagttccatccactagtcaatttcaaaattacctcgtaaatcactaagacaataggaaagaaagccttactataacttgccttactataacttgtcttactcccaaatttagcaatatctttttagcttattgatggtatttcaggaaaatcaaatgtagttccacattataaggatggagacatgtgttacctctttatgttcctgtatggcaaattagttgatactctttggtcttgtcgacatctctttaaccttgtaagattataaaggttagaatcatgtttaccacctgtaaaaaaaaaaaaaatctgacagcagtgggttttttttttttcttcttcttctttttctccaccacatcccctgataatgatttccatgggctggaaatactgggaggagagaaatatttagttgaattcattttaaatgaaaccaatagcttcactagtgatctcataacctcaaagcactttacaaactgagtaatcattgaagatgctaaatatagtaaatacaatgtttaaaaccttcacaaataaatccatattaaagtcttattctaccacaaagtagctttgcttttgatataccttttaaagtcatggatttcttgatggagatattgagttgggttgttcctgttgctttttgtttctttgatttttttttttctattatataagctagacctcactctcttagtcatttcattatatgtagagacaagatgctgccttaactagagctttattccaggtgcccaaaggtcttcatttagttcctagctcaattcgtgagtaaatatttcttttccagctttaaaattttttaaatgacattgtcaggcacggtggtgcatacctgtatccccagctacttgggaacctgagatgggaagatcacttgagcctggcggttccagtctgtagtgcacagtgatcatgcctgtgaatggccactgtactccagcctggacaacatagcaagaccccatctctaaaaaaaaagaaaaaaaaagaatgatagcatttcctttacttgtggagattttctgactataacatgcacactattattataaaataatagactttacaaaatataatggttgtagtttcatttgcactaaataacgataaaccttatttaagtgcaaccttattttatatatatatatatatatatacccattaatttgattgtttttaatgtagccatggacatggagagttcacaaattataatttataaatgtattaagatagaataattgcagaatagaaggatttttaaacaatttaaatagtcaccatttctgccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggaaggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttcatacttataacaaagcggattaatatatactcacctaagacaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcagggattggagaattgtgagctctaaatgataaaacgttgagtcataggttatcactgtacagagtgatcctttggcctctgccttgagggcacgtaagccattttttccttacttgttggaatttgattcatttcctctttttctcctttagctctctaatctagaattctcagtttatctataaaaggattcaatatctgggttgatcctgaggagtcaaagggttggttttgtgagcagatgggtggcagacaatagcttttgtagagatgcctctgaatgagcccacatggtggggctttgagaagcctagtgtggaatcagtaacaaagtccaccttggaataatagtaccatagtttcagtaactgctgattccaaaaatgtttcctatcacacatcttcctcatctgcctctcacaacaatcgtgtcaggagaaagctaatccaactataaagtggctacgtgatcagaaatgacaggatgggttcattgcaatgtcaagcctcagtagtttttcatcaaagccctcaaaaaaaaaaaaattccaccccaaactgattgtgtattattcaaccagacttctggtatcttcaggcacactgtttgcaaaggccaggcatctcttatgtcctgctgtctgtagacctctgtggtttatggatgggaaaactcaaacagtctgctcttagatggtccttattgcagaaagcaggcttatgccctgtaagccgggggtatctccaaatcgtgcaggaggagaggtactgattgctcatttgcttcttctgtgccttaaaatcaccatccttgttaaagaaatgcaagcattgagtagagaagtgtcttgcttgggcttgcttttgagtaccgggaattcagctttcctgctttggaaacctgagttgggatgtaggtgtgtagcaaaaggaatgggtggaggcttctaactaatggggaaggcatctctgaaacaagctgagatgtggatctgggattctgggaatcaaataattcttcccagcaccaaactttgatgagagaatactttaatgtctgtggttgcagaataaatatgattcactctgaggattctgcactgcaattgaatatgtcagaaaaggcaaataaaaaattggaaaatttatctgtaaatagttctcaatagttttagaagagcttccaaggacattaatttcttcctagccattatttattaaaaccttcaggatagcatctcattttttggccacactaatgtagcaactaagtgtgcaggccctggattcagagctaaatctgactctttcaagctgtaagcccttgagaaatctacataaatctctctgtgcctcattaatgtcaactgtaaagtgaggaataatgatattatgtattttgtaaggttgtccgaatgtttaaattagattataatacttaatattaattgaccactttggaagtgagcattgttctaaatgctttaagtatgaattttattgtcatcgccatccatatcaattatccttatttattatgctgttataagaagctttgatttcacaaagaaagaaattcaacacttaaggaggaggcatgagaaaacatcttattgaggtttttaatcatcttctagtgaaccaagcaagactgaacctttattgcaatgttttactaggctttatagcacttttaaagggtcaggtaaataaagtcataattcaaaacagctgttacggggtggggcacaatggcattgatatcaagagactctagtactgaatcagttacttcctatttatataattaaaaaatttttttgttgttgtttgtttgttttgagacagagacagctctgtcccccaggctgaagtgcagtggcacaaacgtggctcactgcagcctcaaactctcaggctcaggcctttcccacctcagccttctgagcagctgggactataggcatgtgctgctatgcctggttaattttttatattttgtagagatagggtttcaccatgttgaccaggctggtctgaaactcctgggcataagtgattctcctgcctcggcttcccaaagtgctgggaatataggcatgtgcccacacctggcctatttgtataattttgaataaatcatttaatcttgctgagcctcaaaaagcaagctttaaataaagaataaattaaaaattaaaaggttgaattaggtgatatcaaaggttcctttcacatctatgattctaaatattactcagtatttactctgtgcagaatgtctatttccacaggctattgcttacagcacaacacagtgatcatattcctctttcgtaactagggagctgagcaccacgatgctggctactggcagagtttatccctcagcccatattaagtctagaaatgattttgtccaactgatgttttctcttcacatcagatgtcacttttttttttttttttgatatggagtctctgtctgtcacctaggctgggtgcaatggcgtgatctaggctcactgcaacctccacctcctgggttcaagcgattctcctgcctcagcctcctgagtagctgcgattacaggcgcacgccaccatgcccagctaatttttgtatttttagtagagacagggtttcaccatgttggtcaggctggtcttgaactcctggccttgtgatctgccgaccttggtctcccaaagtgctgagattacaggtgtgagccactgtgcccaggcttttttttttttttttttttttgagacaaggtctcactctgtcacccaggctggagtgtagtggtgcaatcaaagctcactgcatcttcaacttcctgggctcaagccattctcccatctcagtctcccaagtatctgggactatatccagttatttaattttaaattcaccacactcagctaatttttgtattttttgtagagacatggtctcactatgttgcccaggctggtcttgaacttctagcctcaagcaatcaatctatctgccttggcctcccaaagttctgggactacaggcatgagccaccacgcgcagccagccatcacatttttagataaaacatcgaggaagtacttatactgatatatacattttactatagcaactatagtaaagagaaaccagtgagtcctaaaactgaatttttaaaaaaattagaaacatagagttaaaattaagattatactcaaagttcttcagagataagtattaaagtcatatttccaaacctttaggcactataaagaattccataaataagaggttatttaaaattaaaaaaacctatgctcaagcaatatctttgatcataagacaattctggcaatgagacaaattcttgaaatctcaacaacactaacatgggctcagatttttgctttcaataaatagaacctcatcaaagaggtcttggaaattctgctagtcaatggaataaaataatgaatcggatagaagtcctccagccctgtgctggaccgaaatgtctctgactgcctgtcatatttcagaggatcgtgctcctcagagcagtgtggggctggcacagagatgaaagaaagaagaggttcctccctggtttctgtttatttgaacctgaatcagaatagagaggaagcaaaggagaatgaatggtgtgatccaacttttcttccatatgtgaacaatattgacttatatggcataattatgcccagatgctgtcgtgacagggtgtagagatttctgacttgcataactgaatatattttttaaagacaacaaagaaaaagaaatcagtcacaacattgctttagcatcttgagtcttggagtgcttctgccatggaaagttatagtctctgctcttttctgcttagactgtatcttaaaactagcttcaatattggatggcctattttaagggagatcctgacacttagtatccaaattacaaaagatgactaggttactgaggatctgaagattgtcccatataagttatagttgaatcttctgtggaagtttaacttggataaaataagcagagaaatgacaaatgtgttcacatatgtgaagatcatccttgtttttcttgttttgttttgttgttttatattctaggaagcacagtggaatttgaaagacagactttagatcaccatattggagacctttataacaattaaaacataggaatggggcaggaagccttattaggtggtgagattgtgagattcctctgctgttgatggagactagacagaggccagatgaatgtgtcaataatgttgcaagcactgcttccatattggctagaaatttggaaggttagaaaaagtcaccaactctatcatcataagaaaactgagttgagggcagaaagtaatatgatatctgggttttggggaaaccagttacctctcttcaaatctttaatgtggaaagaatgaaaccatcttagacctttttgagtacagaatgacttgaagtcagaggaaggagcatggcagacacagaatgtcccaaattgagacagcatcttttaagcaaattgttgtccctttgggtagagtgggaataataatatcgcactcacatttatctcacagatgctgtgagggtgtgtgactcagtgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgcttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagcaaaagtaaggccatcacaaaagctgaatgtcccaaagtggtgctttttagcagaaaatgtaatttttttaagatgaaacttgccttcagtgttcttagagagtgggttccatattggtttctgaaggagagtcaagcctggtctccacagtgcactaaatgcagtagggggtcaagcaaatgatgggaaaagcataaatcatcttggaattatagattcctctttgctgtttgactttaaattcaccatctgctggctgaatcttgatgggagttgaacataaacataaggccagtgcatgactgtgacgtggaaggtggaagaaagttccttctgacttgttaaaacccttaaaatctacacattattattattataatttagacaatgtctcactctgtcacccagactggagtgcaggggcacgacctcagatcactgcagcctcaacctctccagctcaagcgatcctcccacctcagtttcaagtagctggcactatgggcatgcatcaccatgcctggctaattgtttctatttttttgtagaggtgggttttccctatgttgcccaggctggtcttgacttcgtgggctcaagagatcctcccacttcagcctcccaaagtgctgggattacaggtgtgagccactgcgcccagctgacatctacagattatcatctattattcttgtatttgttaaccatgatctcaaaatgatttaattataaaactcaaaccttaaaggacaattggattccaaaatgtagattatatgtagataatatttctgttcacaagtctaggtgtacattagtatccattcagaaaagtgaaaaaaagtttaaaagcatttttaaaaacatgatgaaactataacactcaaaataatgtgatgggggataaaaggcagttgattgataaatgagtcattgacaggtcaatgctgtaaaaggccgagtctaagttgatggctctcagtcctggttcgtcactgctgttgtggaacttggcaacgagtccctcttgggaattataggcttagcatcatgctcttgctcgtattagctgcttcttctatcactctttcaacagtaacatattaaaaacaaaaacaggaaaaaaaaccctcaaaacttctcaggtaagtagtattaaggacacaaaaatatttcaggcttgatttagaactacatttatgaaagtaaactacgtgatatagagcaaaaccacaacctttaggttttggggggttttggtcttatttctctttttaaaaataagagatagggggtctcattctgtcatccaggttggaatgcaatagcttgatcacagctcattgcagcctggaacccctgaccacaaagggatcctcccacctcagtctcctgaagctagaactacaggcatgtgcctccacacctagctaattaaaaaaaaaaaaaaaaaaaaaaaaaaaaaaaaaaaaaaaagtgtgtagggaaggggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagctctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgcctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcggctcacgcctgtaatcccagcactttggaaggctgagggggatgtaatcccagcactttggaaggctgaactcctgagttcaggagttccagaccagcctgggcaacatggcgaaactcccaactctacaaaaaatacaaaaaaaaaaaaaaaaatagctgggtgtggtgatatgcccctgttgtcctagctaaaggggaggctaagctgggaggattgctagaggctgggatgttgaggctgcagtgagttgtgatcataccactgcactccagcctgggtgacagagggagatcttgtctcttaaaaaaacaaaagtttcttcaaattgcccctttacaatttaatatgcatgaacacatttctttacaaagagaaggttatcttttatctatattcaaaatcatatgccctggggatctttacatcacaatgcaaataaatgttgagttaaccaaaggaagtgtgagtaacaagttagtgactgggttagggggtggttaggacagtggcgtgtgattaagagatgaacatctcagaccgatgcttagtaaaacctacagggggaagcatgatgacctagccttgaatatctcatttaggaagttacacacgtgtctgggcttttcaaaatgtttgcatgccattaatcagcatcttacatcagcttgctcaatgaatgatgactatgtcaaatggaagtaaaacatataaggccagagaaggatgaagggaagttttttttaatgcagtaaaggataaagaaggatggaagtggccaggagtggtggctcatacatgtaaccccaacactttgggaggctgaagtgggaagatcacttgaacccaggagtttgagaccagcctgggcagcatagcaagaccccatctctgttttttaaaaataaaaaaatataaaaaaaagaaggttgtaagttattcaaacccataaggagttcagccaatgtattgaggtttcacactttagatatgatcaatttgctgtctttggccttaaaggaaaaacacaaacacagcagcctcgtgttcttctcagacattggtttctcctcctttcttcctaagacagctcttttcccactttctctctggccaagtccatgctcagcattgcgtgacttcactgttagtctaggtttattctgctctgggaagtttccctgacccccttcttgacagctgcagatcctgtcagtcacttctctgtgtgcttcccttgccttccttgtagatttttattacatcaattaggatacaccattacaatgcattattttgtataataaacacctgtatagtttctaccatatgccgggcactaatctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccatcattaaaattttgttctttatccttccatgcattgtttaatgtaccacctacccacacccatacacagtaattaaatgggacaatataaccatttttttaaagaaggatggacatcatctgctctcatcctaccagagttgtctatcccaaaaagacaggttaaaaatctatgtgttttttctataccttttattctctcataggcttgtatctctcatttacgttaatggaactcattggtgtttcaaaaacatgatcatcttaaatgtactcttttagatgttgctttgctcactcagcagtcaccccatgtcacctggcaaagccctaatttatttttttcactggccacgtgacattcattccacagtgtagatgtatcacaatgcattcaggtattctcctatggtattaacttggcttctagaatgcaggggctgtctttaaccctggtgtttgtgacattgtgatgggcataatgggatcccttgaataaatatttgtaaaacatggatggaagtcagattttagaaagaataaattagttttttcttaattatgcatggatatggtcttgaatcggttctcaataaatcaaatttcagtaagggactcacttaaatgtatgagaagagacccctgtaatcaatgtttttaaagttaaatgattgtcttttacattttaactggtgtaaaataactaattattgttccaaatagaatttttgcttaaagatacgtacaatggaacgttataaaaccacctatatttacagataccttgtgctttgtgatctggcttgtatttttcctgttcctttcctgttaccctgtgtacgaaatgtatgttcttcccataaaaaaactaaactacttccagttgtgtaaacacaacagattctttcagaccactatgccttggtgtatgtcaaccctcagctaggaataacatttccatctctgtgattccattggcaatttctgctcaccttttcctaggttgaagtgccacttcttctgcaaaacttttcttgaatctcctttcctgttaccctcctgcacaattaaaaacttgcatccatttgatcccatagaatttatgctgtacttacatgacaggtacttacatcttttattttaactcatttatatcacttacaagactgtttttttctttaggacttggaatatgaccttttcatctttttcactgcagtctttttagtgtccagcatggagaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgagtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttattgctccttagaaaccggtaactgaaaaggccctgtttcagaaaagcaagatatgtcaaatgggaaggaagtagaatagctatctggttggaattcagaaagtatatcaaggccaacaatataattgttgaaattggttattaatgttttgatactgtgacatatctgttttctgttctctaccacaaacaagaaagatgttgaaatatggcaaatgttatgaataacaaagaggaaaatacaaataagttcttttggcaaatctccgtagcaggttgaactcagactcctttaatgtcaataaacaaggctcagagtcaatgccactttctttggtggtcactttaagtgtatttctcttacaacagccctgcacgtccagtgttattattactgcttcacagataagaaagtggaggctcagaaaaataatgatccataattgatatagtggtatatatataatttatatattataccataggatttaaactgaagtggtaaagcaggtggtaatttgcagagaatgattttggaaatgctccgtagatacctctggctctaggcatataaaactattttcttattaactgaaaatttacaattacaacttgattcttgtggtttaagacaatggaggctttctacatggtgcatgcgaattttcccaaaatctttcccaaattcatttataattcagtgtgggtgagcttaccagttcctttccagaaaacaattgtgattaaggagttcacacagacaattattctgttattctcctctgtcctcaggtaggcagtgctcctcgagctttgggtggcaatccttcaccaatccattgtcagtgtgggtccagcttttcctccttaggccacaaagatagagttgctcatattttatttccaaaatatagtgttaggggcctgaaggccacaaagaagactattctgaaagctcccacactgacatcctccccagtactggaaaacaagtaataaaagagtaggaaaaaagacctcagggccttgcacataataggccttccataagtttatttcataaatgagattctgcttgacggactggcagatggagcctgagtttatagtcctgtctgttattaccttgctttgggccctgtcataacacttcctctcaaacacgtttgaaagaaatgcagcccaacataggccgtctcctcgctgtgctgagagggtcttgggtctcacaaagcaacacacacagccaggtcatgtctctgagcatcggatctagaaaactacaaagccaggaagacatggacaatgctaacatcctccctttgtccaccacatacatgcatgaaaacacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggtcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgaggaaaagaggaatccaggcagagagaatcaaaaatgaaaagtcctcatggcaggaatgagcctatttcaaaaaaaattaaaaaacaaaaaaatctgggtggcttaatgaaaaagaacaaagagacccaagaggctagtcagtttcgactggtgcttagaggccatggtagagtggacatttttttgtttgtttgtttttgagacaaagtcttgctctgtcacccaggctgaagtgcagtggcacaatctgggctcactgcaacctccgcctcccaggttccagcgattctcctgctgcagcctcctgagtagttgcaattacaagtgcccgcagctaaacccagctagtttttgtattttcagtagagatggggtttcaccatgttggccaggctggtctcaaactcctgtgctcaggtgatccacccgcctcagcctcccaaagtgctgggattacaggcatgagccactgtgcccggcctagagtggacattttattctacatacaatgggaagccatttgagggatttcagcaaggagattacatgatctcaatggacttcttatttttctttaattttatactttaaaaatttttgaaacaggggctcaccctgtctcccaggttggagtacagtggtataatcatagcccactataatctcaaactcctgtgctcaaagctatcctcctgtctcagcctcccaagtagctgtgactacaggagtacacaccatgcccagctaatgttttaatttttttgtagagatggggtcttgctatgttgcccaagctggtcttgaactcctgagctcaaacagtcctcctgcctcagcttctcaaagtgctgggattacatacatgaatgcacctggcctgaatgtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattttgattaagagaaagaccctaagtggctgaaggaacaaaaagagttattgcaaaaaaaaaaaaaaaaaaaaaaaaaaaaagctgatgcagttaggaaagggaagcctgagctattaagaaaaacacattgcttcttacatggtagtgctaaaggccaagcctgcatatccctgcaatctataaagtctgttttctctgacagtgtcagagttggaaagatcaataggtgtcactcacaccattcatcatctcagaaatgagaagatttaggaaaggagattgaaatgacttatgtggggtcacagaactagttattgttgagaccaaatttagagtcttgtctcctggatctcagtattatactttaattatttcttttttaacatgtaacccaatttgctcctaatagacttggaatacacagtgcctgaaatgtaaagatgacttactcttggccttaaggcatcaaatctgccacacgaaattttaagataagcataatacatcattggaattactcctgcttcttgtacctctttcacatgagttaccatgaagtgaactctatcttttatggaggagaggatatggaggagcataggagaaaggtaccatgtgaaagaataaataacgtctttgccttggactaagttgcattgcagttatcaccggaagttgacagctttggataataagcatggatcttttttgtctttgttggagcctgttgcccttcacctttatgtaacatctaaattctttattctggttgacatgggttgctttacaattttaacttggcatgtgtcatacgatcataggtataatattctacagttacaaaatatgtttgataagtatgaggcattcatgctcattgtgaaagccttcaaaatgtctgtacgctaggagaatggtgaaaaacaagcagtcaagtgagtctcagtgggttgttttctcagaccacgtggactctcttctcaaatctggtactggttttacgtgactttggagaatcttcattctcaatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattgtcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaattgtaatgataaaaacttacctatttcatcagttcctctcctttgcccctaaaccccaaatactcactttgtctcttagatatcttgaagtagagttaataactaacgagaataagcatctccatccatgaaatattttaaatatagtagtgtggacctaaaaagatagtgaaattggataggccatgaatagaacaagtcctcatgtcataggcaaacatccagaaagttgtgtgttttgcatttgtgttttgttgtttacatctgttgcataggaatgatcatagttacaacagctgacatttaatgaggacttttcatatgttagacactgtgctaagagctttatttacatgctttatctaatttaatctgtacaaccaatttatgaaatgggcattttccagacaaataaaatgacgtttagtaatttcattttgattgcctgtagtcaccgccaataagtattagagggaatattgcaacccagtcaactttctccagagtttatctttctgtattcctcagctggttgttggaggttgattgaaaaaccctttgtaagccttgaaatgctaaatagtctacataggaaaggcttctactattgtttctacttttttttaatggtttgtaatctcagcagggattgtgttatctaaaaatctgcttgatgaggtctgagatactggcttttagaggtcagacaggaatgactgcaagataacttgactttctccttcccctctgctgctaaggggtaaggtgggagtggttctaggacttctgccatagaactagatatgtgatggataggaaatgaaaaaatgtgccactactgcacaatgtcaagagattaattggcatttaatgaaatatctgtgccatattattttatagtgtgcaacatttaaaacaatacacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctgtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaacaagctcaacactttgtattcattgtttcttttaatactcatttcaagctcctggattcagtatcattatctccatatcacaaagaatgagggactctgaaaaactcaagaactttcaaggtcactcacagaatacatgcctgagctgggattctaactcaaccccttaagcccgatatcctgtactttttctgctatatcaggggtcagcaaatgatagccaatgggccaaatcttacatgctgcctggttttgtgaatgtttcatggaacacagccatgcccatttttttatgcactgcctgttgctgcttttgctttacaacagtcaagatgagtgcttgaaacagaggccacatggcctgcaaagctacaacattgagtggccctgtatgagaaacacttgctgaacccaataacaatacgtgagagatgtattgttattgacaataacgaaacatgagagatgtagctcaaatcatttaactcagtgtgtctacatctttttcctgtatcttcaaaatccaacaggataggtctatagatatactgtcttaagcccagcttcttgtatacatttattttgttccaagataacgtgcagaaacccgaattccagataggtctcttataatgagtcatgtttaagagggttctattattccactttgcatttctagaacatacttctttcagaataattactttctaaacctgttcacttagcaggcagatggaaatccaacatcctttggcagagaagagagaggaattttccactcgggcaaagtgaagcactggtcagctcgtggctgaaattttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggccacataggcacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaagaaataattacaaaatatttttgaaaaagtgacattttattcatagtaattcatgtaattccaactgaagtaattgatactttgtaatagtaaggacctattcgagtgaatgtttaagatactaattatatatcaattttaaattatttaatatcaaaaaggcttgaaagcagcatattttgtgtcattatgtgaattcttgctttgccatttttaaaactatttgttttctcataccccctcctctttattttttatgatgtcaaagactgtgtcagtcaagtctgtctctatgtcatttgagtttatgtttatgtgttagtgcatttttacaagttaactatccagaaacatgcacactctgggcagaataaaaaatgtctaagttaagtgaaaaccactttaaagcatggcagccaaaatagctgtagaaaagtttatgctctattatgtacaattttaatagacatgatatcttgtttcccagaatacaacagattgactatcagtcattttgtaaaaaatgaaagcaaaactaacaatcacaagagctaagatttgctggccctttgcactgtcccaggcactagtctaagtcttttgcaagtgtttcatttttacagcaacacaatacatttcctactgttgttatccatcttaaggaggaaactttgtacagaaggtttaagtagctaatcaagttttcacagctgataagggatagagccagagtccacaagcagtctagattcttaatgccaatgctgtattgtctctccagaaaagaccactctcacctttccccttgttcttgataatacagttaaattattcatattcatagcataaattttctgtatcatatttaagaatacagttaaatattggtgcatattagaaagatttcacttaaatatgactacatgaaagtagatttgtcttttctaaaaaataaacaagcatttgttttctaaaaaatttactggcgtgcaccatttcatttcctaataattcagaataaatgaggtgtcaccgtggtccacttcaacagtagatgggcttatattcaggcaggaagcatgtcacctatacaacacagatgtgggtgattaatgaaaactaaatcatggggatgagatctttaagaagaagaaaaccaagttgtcttccagaagtgttttcagaaccccctgttttgaggttgtggatagacatgacggttttacaatgccaaaacagtctgttctaaagagaaaaagttcaatcaaccatttcacctgcattatgccgaagagctagtctttacagtcatggggctttaaaactattttgatagcctgtttgggctgcctctaaatatatcctccaaataaaaacctcagaaaatgtatcagagaaatgtacataattaatatttggcttaatatattgtcaactttgattttacatgtcccatccaacttgttaagccttctttgtggccattagtgtttactagagaataatatcatatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccatttactcacaatacacacacagcctcaatgacctaataagcagatttgcagagccataaccttgctggcttatgtcagctcgaagtaaaaggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttttacgctacattggatgtcacactgttctgagtttagtggtatcaggtcatcagattctgtaagatgtgattctaaaaattcagtcctagtcctaccgagtccattagagaaggtctgcagtatataaaactgtgacttaaaaaatgctcaatcttccatgcacataactgcctgatgactctcaagctcaggtgtgaccttcatagacaggctgttgtaaagtctagtaattccttcaacacaaggtaacttagtatttaaaccttgaccacacatcacttcagaattactaaaggaacttaaatatatgtcagagctcctcttcggaatataggacaatggagcttatgcagatagcattactttaattttaattgtacccatctgggttcttcgaaatggcaagtatttcgtttatgtgcctttctcatcttgggtcaactcagttccatgcactttaaaattattttaggaaagagccacatcttttttttttccttctttctctttctttctttctttctttctttctttctttctttctttctttctttctttctttctctttctttcttttttgtgcatgcatgcgtgcatgcatgtgtgtgtgtgtgtgtgtgtgtgtgtgtgtgtgtgtgtctcactctgctcgcccaggctggagtgcactggtacaatcttggctcactgcagccccgacttcacaagctcaggtgatcttcccacctcaccttagcctcccaagtagctggaattacaggcacatgtcactacactcagctattttttttttttttttttttttttgtatttttagtagagatgggattttgccacattgcccaggctggtcttgaactcctgggctgaagtgatcctcctgcttcaaaagtgctaggattacaggtgtgagccaccatatttggccaagaaccacatcccagtgctgtagaaaactccaaaaatttattttgcaattcaaaatataaaagtttgttagtagacatttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcgtttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtgcaagcactttatgatttgagggagtaatcaggttatattccttctgttggccagaagtgcctgttgaagaaagacttggctctgttgtctggaagctaactatgtagactgatccacagaggactccatattcatcttcttgatactgagggcttcatctgtgagttgtaagcctgtaaatcctctgtttcagtggtttcaaagttccaagagcaggaggaaaatccagactgcctctgctgctgtgcagagcaattagacagtttgagtgcctcaactgttcctatacaggccagtggagtcagagccttaaaaagaccctcttctcccagtgctttctcaagtaagtacagcaacctcaatgtcttatagtatcactacagcacaatacatgagtagttttacatttgaagtaggattaaattaaaagtaatacattcacatggtaaactcaaaagtatatggccaggtgcagtggctcatacctgtaatcccagcacttagcgagactgaggcgggtggatcatttgaggtcaggagttcgagaccagcctgactaacatagtgacaaaccctgtctctactaaaaaccctgcagagacggccaaccccatctctactaaaactacaaaaattagctgggcatggtggcacgtgcctgtaatcccaggtagttgagaggctgaggcaggagaatcacttcagcctgggaggcagaagttgcagtgagccaagatggcaccactgtactccagtctgggtgacagagtgaaatcctgtctcaaaaataataacaataaatgtatatatagatataaattatatattaattctatattttatatataatatatactataatttatatacttataaattatataatatacaaatatatatttatataaattatatacctataaattatatatataattatatataggtgaatatatacagatgaatagttatatatgtagatgaatagatatatagatggataattatatatagatgaaaatatattcacatgttatatgaatatataagtatatatttatatataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatttagatggtccacttactacagccccagaatggaaatttcttcctcaaagcaaacattagaggcatcttttgggaaaaaaaaaaaaatctatatttatctcattctgttcttcatttaattagcataatccctgttggatattttcctcaccaaataaggaacctgtaattaagtgttatattacatgtgcttatttctcttcctggaagtccattttttaaaaatatttttaattgatatagcatagttggtacatatctttggggtacatgtgatattttgatacatgtatacaacatgtaatggtcaaatcaaggtgactgggatatgcatcacctcaagcatttatcttatctttttttttttttgagatggagtcttgctctgttgcccaggctggagtgcagtggcgtgatctcagctcactgcaagctccaccttccaggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgcccggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcttctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagattcctaaactctctaggttaacacctcatatagtaatgaaagtataatcagttcacatgattgaaatcctctctagtttaatgtacttgttgcttttccatggactttgaaaacatgaaggtctgtagccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcgtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaaattgttgagtgtccaagatgccacatggtcaatggattattaccctgtggattcaaatctgttaccaattactctaggggtttattgagtggtcctgcacacccactttcctttgtttttctaattatcgctgcacagctaatcctagctcaaaaaatcaattcctctctcatatctacttacatatcctctttaagccccttctgtgtttttttgttttgttttgttttgtttttgttttatctcacttccatctatttcctggttatttcaggaaaagttcttttcacaccactttttagtggattccatcctgtctctcttcttgtgaccataaaataaaatttgtcataaacaaatgtaagagtctggatgtttctacaaacatttaagtggcaggaagaagctaaagccatatttttcagtcaaaatgttagcagagattttcctgcactgtgcatgatttattttctttctttatatttttagataccttataaattgtctaaaatctcaatgaacaacatttatggtcaaataacataaagaaaaatcctttatagccacttacttactcaattgtatagtgttttgacattctaactacactatcagtatggttttctgttataacgtagtataggtatagattttagccacatagtaggtgaaataggctatgtgttaatctagactaagacacagccattatctataacatatattttatgagaatttgcattccaaggtaaaaacaactgtttgaaaagttaccttttaaacaaatccagttcatatggtgcattactttcattttctgaaggtgattcatatggaagtattgagaagagaaacatcatagtttaaaaaaggccaatcagactttgaggacaagatccaaacattatgcaactttatatcttagcagagtgcacttagtaggtgttcaataactctttgttggataaatgactttatgagtaaatgaagaaaacctcagagctattggcttcctgtgccttgaattacacttttgagtgggactgccttctgcaagccagttgaaaaatagctattggctcacagagttcacctttattttgaggactctgtcaagacaccttagtgcatgttcctagttatgtgaaagatatgctgccaatcagaatcccaatggtctccttgtatgtttcatctttaaatggggctgcgctgttagggacaggatatatcttggcagactacatggatatgaaaatttcaaatcttcccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttacttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaattgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtcttccagtgatgatccagctctttgcagcagcaggattgtggctggccagaagcacacttgatttcaaaatggatgtgacgggcaggtcacctccttttctgcagaagtgtacttgcatcaacaaatctttttcctctcaggttttgaggaaatgggatcaaacattccaacacagagaaataggaggcgtgggcagcagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctctctcttctcaaagttccaaagtgttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacaaagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattcttatatcctgtataataaaataactaatataggaatataataaataactaggaattataaataatataagattgtaataaatatccaaaatcaagggcctccttgaatttgttatatattgatttgttgattttttgagggcagtaatcaccacgtctgtccagatcagcgcggtgtccacgccccactcagcactgtgccttgtccatagcagatgctcagtcaatatttatctaatcagtgctgtttgtattcaaagagaatgtttaacttcttactctttccattcccacctcccctttttgatctcatgtccactatcggtgtactgaggtctcctgggctctgtttgcaggaatctaaaagtagtttttttactttggtactgggacatgtaactccactttttagagaaaatatttcatgctaattaaaacatctcagggctggtctccctgcacttctcactttcacacctacatactcataccccttttctctttttccttactttgtaatgctattagagttgacagaatacttgctgcttccccagaaagtcttagccaggagttcatgaaaccctgtcaggccttgtgaaatgtacagatgtgtttcaaatgatccataaaccctgatattgtataaaatgtgtgtgccattttatggaaagaggatgatatgttttcttaaccaaaatctttcggggtacttcggtccataaaaggctaagatccactccactaatgagcaagatctagtcatttagaaaatcctgcactctctcctttgttactgcctcaatttccttaaaaagctcttataagataataaagaagccctctttacttcctacagttccactccacagcaataccagcttaagtgtgtgccttccagcgtccatcccatctctccgtctgaggggtccccactcctagtccacccaggccaggaaacccataactcatatgtaccagaaaacctcctttttaaatttcctcatgcttcctggcaccctgacctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatgtcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacagaagggacattaactgatggtcacagaccactcttaggactgccattaacttcagatgttaaagaagtgcttcagctctttgcactttgtcttcttcttgaccagtgagaatgttagacgggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcatactgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagctatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatagagagagagagagactatatatatgtgtgtgtgtatatatatatatacagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtcgaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccatacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacactaagtgatagatgctagacgaaaaagagtacatactggctaggtgtagtggctcatgcctgtaatcccagtactttgggaggctgaggtgggcagatcacctgaggtcaggagttcgagaccccccaggcccacatggcaaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagcactctggaaggccgaggtgggagaattaaggccaggagtttgagacatagcaagatcttgtctctagtaaataaataaataaataaataaataaataaataaataaatgcacttttttgtatattgagttatatctcaatgaagctgctttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaatttaaaagataaaagaaactatagaaaaatacacaattatgtatctgttcttgaatggaaaaagattttccaagcgtaaatacaaagaaaaatttatatagtaaaacaatgattgatttaatttgataatttttttagaaagtttacatcaaaacaaattacaaaattgaaaggcaaatagcagtctggttgtggtggctcacttgtgtaatcctagcactttgggtggccgagatgggcagattgcctgagctcaggagttcaaaaccagcctgggcaacgtgatgaaaccccatctctactaaaatacaaaaaattagccgggcgtggtggtgtgcacctgtagtcccaactactcgggaggctgaggtgggagactcccttgaacctgggaggtggaggttgcaccgatctgagattgcatcagtgcactccagcctgggtgacagagcaagactcccgtctcaaaaaaacaaaatggcaaatagcaaaggggataatatttgccacaaatataaaagaaaaggatatatccttgctatataaaaaggtcctatgaaacagggacttagttggatatttctatttttaaaaaggcaaatcatataaacaagtgttttacccacccatcccccctcaaataaagaaaaaagacagggatggagaaagaagggggaaaaaaaaaactgagtaaaaaaattctttgcaaaagagtaaaaaagagatttgtttcctcaccttgatgttgtctttataagttgttttattttaatcttttgtttttccatattttcagagttcctacaatggacttgtagtacggtacctgggtgatcacaaacataatctagggagtagaaaagaagttcaatgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcaccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttccaattcttggttcaaaatacaaggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatggtattcagtggtggttgaccatcatggaattgggagatatttgtgaatgtggctgcaggctgcatgtcctttgtgtctctgactcaagacacacccattgatctcatttgtcttcatttcatcattgggcagaatgcgttctaaaatgaagagactaaaaccttcacagaagcacactctttcaacatctaaggaaaaattgttgatgagaaaactgtgagaacattaggaggtctttaaattgcaaggggaaaggtctgttggtgaaaacagctgaaatcctatggattaaatcaacttgtaaataatgtattcttagagtctgcagtgatctcataggcatgtttaaatgctgtttcttatgactacagtttaaagtcatggtatggactttcagtttcatgaggctggcctgggggaaaagagcatgaggttgaggttgatggtgttaactagagcaactgagcccccatacagaccttctgaacttgctcattaacgaagccacaggatggaaattgtatagtgtccttgaccagagcattagttacaagttgtgagaagagaagaaataagtaagaaagaaaataaatgacttataaaaatcctcagaagatatagtccccaactgttagcacaaagaaaggatgtaaaatcatggaggacagcagtggagaagataacgttagcagacaataaaaggccaaagttttagaacagtagtaagtgtttaagaatatacataatatatcttcctccatttgctttttgtcttcaccataaatagacatgagttaacgtatgtttaaagatttatttcccttttattgagctcacccaacaaaagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggagatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaagatcagcatgacagaagtacaggaattaagaagaacatagtaggtgacaaggctgaaaaatctcatagattctccattttgcagagacttatagatcatcttcaagatagtaatagctgcagagcagaaggctagagcagagaaagaactttgagagataccaatatagacatggtttctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcacaaattctaagaaatcatggggcagagggcaggggtgaggtagggtttgttttgttttgttttgttttgtttgtagataaccaaaggaagaaacgattgatgcaagatttcagggagggtgaatagccctccttgtagctttgccctgctagagagatggtgggtggacaattactataatatttacaaacaggataagtctacgtcagcccctaacattctcagtttcgttatttgtaaaatggcgtaatgatacttatcttttagagttgtttgaagagtacataagagacggaaaaggatttttaattagataaggaaagcataatcacctatctttgattcattcacccttttaaactgattaaagcttagaaaataatcacatatgcagattgatcttagtttgtccacctcttgacaatcagttagtagtatatatgtatttttttatttttaagaatttttatatccccatgcattgactaatcttgccccatcatagataagactagaacaaaatattgctttgagaagtccttgagttccaaagatttaccatgaagctaatgaaacctgcattgcagagtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttcggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgtgcaacaagcaccaatggcatatgagtgttgatgggacaagttttgaaatgtatggagccaaaagctagcctgtggaaagttctaccaggcattcgacatgtggtaaggtaaccaggagactaagttccgtggatgtctagtcaaatggaaattttcttctctcaagaataaacatgataatttcgtgtatgcaattctaaattcaccaaattgtgttttctttttcaatggcaatttcaggaaattaaatgatcagaatccccatgtttccaggggccaaacctgtaatagtcccacagacagtgagtgtgtctataacaactaatataggcagaaaaattcaaagacgttttctgaaatttgccaatacctgtaaacatttttaggacattgtcaaaataagctgtgaagctgaaagaagtttatttaagtattaataataaaaatttaataagctatgctaaataccaattctctttctattatctctatagaaaagattttacaaaatcattctcagatgtagaagcaatttttaaaaattcagccaaaaaatagtagggtgaaaagtattataatgatagcaggtagttaattaatagcatgttctttttctgaattttatgatgcttgtggctttgacaactttaaacattttataattgtggaatttcttttgtcgttttacagaaatattcagttttgtacctcataatttgtatttataattttgtattcttcttcataaaaagggccattgaattgtgtttaactcatgcctcaccaaacctgaaccagcattttcctctgttgaatttctattgcctgcctacagcaaggcccacgtcttcctgtaacagttgcccccagttcccttaactatcaccagggagtcagcagttaatgacatgctcaaccttcctccaattacagatggttaggagagaaaacaaagccataaggccattaaactcatgaggttttgactggtggttcggaggtagagctggccctggctatatctgccgtgtacacaagaaccaaaaataccacacttcatttcagaagatccagatttgatcccacctctgccactggtgtatgatcttcagaaatgaacttggctgtccgaacttcaatccccttattcatacgatagacctattgtgatggccggcaagctgaggtatagaaacacatattatatagtaaggggttcttcaaatgtaatatctgttctcaattcctcttctctatcattaccaaggagccaatgatgcacagctacccatgtaccttcattgtagagacacaccctgaacaagcagacaacatggcgccacatcagagtattatattagaatgtgtgtttggcatttctttagcagaggggccaagtgtaggaagggagcgggtagaaaaggaggaccacaggtgacaagagtctcccctgaccttaagcttgcagttcccactgaaccaaacagaagccctgtatgcatctggaagtccttgcttagtgggctgtgcaatgtgtgttttaggggtctcaagccttcatcccatgtagccatggacaacatgttccaggaaaacattacttcctcacttcattacattccaagtgacatttctgcatcccttcttgacgaatgttgtccaaaattggttgtccctctctttgatccagctctgaccacagagatcagttttacatacttgggtacttccccttggtgattcaagaggaggcactttccttaaatagccttggaaaccttgagacagctgctgcatccatctatgttcattgctcaaacttcctgtatggtttgccaccaggcttaggttcaaatccaaaatcaaaatcttaacatggccacccaggcgcatgtggcctcagtaatacacagtttttgagcttcatctcaagcttctcttccccttactttgctctccatgcctgcttccagctcttctgcttcacccagtccttccccatccctcatgtcacacaggttagcttctgtgcccaagtagggtcctgcttcctttcacaaagctgactcccatgagctctccagagatgatctcaagtgtcacttttgtggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgtggaatacattctggatgcatgatgagactactgagacaatcacaatcttgtaagtttccttttcttctaagataaatctcaagcagagattctcttctcaggaagagtagaacttttcacaatctcgagccaagtaaacactctcaaattgcaatgcaaaagattttgcaaaatacttgaaaaaatgcaatttataaagcagaagttgtacagatgccatggaagatctaatgaaaaatcagaaaagattgcagcacagatttaactcttctcaagacagcaaaagcaccccacatgtgacagatactcatgagaacattgggagcctgaagccccgttttccagacaaggaaggaattacgggtctctgatcacagcagaggggccctcattagacccatcaaggattgcacgtgccctgtgcaaggccacatgcgcatggggtgtgcaattaactctgcccatgctgctgaagtttcagtccattagtctgagtgaatcttggtcatttgtatccctcttggtgcctcataaacatatgcctcatagtctgcatcttcaaactttttccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcgagtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcagtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggaacttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtcttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaatatactatgaaaagtctccctctcccctttttccttgggcacctagctagttttgttttagtttttacctagctctcctgagacagtgtgcatatataagacaaaatatacatatacctcttttgtaatactaagacaccaaattcatacttctgcatcctgccttttttctttacttaacaatacatcttgaagatggttcaaattacacatatatagataatttttcatgactgatttttaatagctgcatagtatttctatattttaatgcactgtaatttatgatattgtattgacaaccacccgggttgtttttaatatttcatttttacaaataataatgtgataaacatccttgtacttgtgagatttcttttcctatatgggttatttatctttagtagagcttcttagaattggaattgtgaagtctaagtccacattttaagttttgctagataaagctacattgccccctttaaagttgtgccaatttttactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactactttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcatgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagttggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacaccttttttccataaatggctaaatagtaaatattttagacttcatggatgatacagtcttggggcagctactcaactctggccttgggcgaaaaagcagccacagacagcacaaaaaccaatgggcataactgtgatccggtaaagctggtgtagacacacaggcagcaggaggatttgaccctcagattgtagtttgctcacccttggtgcagaagattacttaattattctaacaaaattgatttagtaaataattttccccattgatatgtcttggttcctttataatacacaacattattttttataggtaggtcttgtacaaaactctccatttgattttattgttctgtctttctattcataggctgggtatgacactaatttggttactatagctttatgtatatttttaacattggatgaggtcagttgctcctcaaaactcttatttttcagaattttgtgcaggaatatctgagtatttctaattagattagaatgtcagaatacattcatggacatatgagtttggggttttttaaaattttttttagatatccttcaccttgaacatttattatttctttgtgttgggaacaatccaaatctctcctagatgttttgaaatatacaatgtattgttaactgtagtcaccctactgtgctattgaatactagagcttgttccttctgtctaactgtatgattatactcattaaccaacttctcttcatctgccccccacctccacccatctcagcctctagtaactaccattttactctctacctccatgacattaacttttttagctcccatatatgagtgagaacatgcaatattttgtctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatattgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcattttttagtagagacagggttttgccatgttggtcaggctggtcttgaactcctgacctcaggtgatctgcctgccttggcctcccaaagtgctgggattacaggtgtgagccaccgcatctggcctcacattttctttatccattcatccattgatggacatttaggttgcttccatatcttggctgttgtgaatagtgctgcagtaaacatgggagtacaggtatcattttgatatactgaattcctttcctttgggtaaatatgtcatggtgggtttgctacatgatatgatagttctacttttagttttttgagaaacctccgaactattttctacagtggttgtactaatttacattaccaccagcaatgtataagagttcctttttcctttttccacatcctcactgacatttattactttctgtctttttgataatatccatccttactgagggaaagagggtatctcactgtggtttcaatttgcatttccctgatgattcgtggtgttgaacttttttttttttcagatacctgctagccaattgtatgtattcttttaagacatatctgttcattcctttgccctctttttagtgcttttacatatttggcttttgtttttttgttttcgttttcattttgctgttatgttgttcctggatatacaaggaactcaaactatagtcctttgtcagatgaatagtttgtaaagattttctcccattcctcagattgtctcttcactatgttgattgtttcctttgatgtgctgttagtttttagtttaatatggtcccatttgtctagttttgttttttgttgcttttgaggtcttagccacaagatcttcgcccagaccaacatcctgaagtgttttccctcttttcttctgtagctttatagtttcaggtcctaaatttaagtcttcaatccattttggtttaatttttgtaggtggtgagagattggggtctagcttcattcttctacatatggatgtccagttttctcagcaccatttattgaagagaccatcctttcctcaatgtatgttttcagtgcctttgtcaaaaatcaatcagctgtaaatacatgcatttatttctaggttctctattctgttccattggtctatacgtctgtttaaacaccaataccatgctgttttagttagtatagctttgtagtatattttgaagacaggtactgttatgcctccagttttgttttttgctcagtattactatgagctatttttaaaaaatacttccaaagaaaaaagtgcaaaagtttatattagcttactatagttttaataggttaaaattagtagcttctgagtaatgaagagagactgagcttaatttctcctgctttgaaagtacttctagggtctgggtgtggtggctcatgcctgtaatcccattgttttggaaggtcaagacaggaagattgcttgagccccagagttcaagaccagcctgggcaagatagcaagaccctgtctctaaatttttttttttaattaggcaagaatagtggtgtgtacctgtagtcccagctacttgggaagcttgagcccatgagtttgaggcaggagcacgctatgatcatgccattgcactctaatttaagcaacagagtaagtcctcatctttaaaaacaaacaaacaaaacaaagcaaaacaaaagaaagtacttctatttatttcttcacctgctaatttagcttgttcaagtgtagaagctggaggatgtttccctgcaatgacagagtagccaattttgtatctcctgattttttccttctctcattcttctttgctcaacagacactaaattgaggtttgtgtccttgtaaatagtagatttcatttaccctctgccacctttgtcaaaaaataattttaatttaaaaaatgatgtaaacttattttagcaaaattgaagactatagaaagctatgaaagtgaaaatttaaatcaccgtaacactgcactcagagataaccactgttaggacttttatttctttctttctcttctctatacacctgtaacatgcatgtacacctactgcatgcatatgtgtatgatacatgtgcaaacagtgcatgctaacattttctaccctgcttttccatgtgttatttttatcctgtgttccactattttggaaaccgtcagggttgacagagggaaattgatcaagccctttgtcttcattgatgtcaagagtttcagtcaacttggaggccgtggcctcctccttacaggcttcttcagcctttggtttgagtttgggttttttacttttcatttttggaggagccacgttctctctcctttcctattactggagagccgcttcctctcttcactcattcattgtgcagtgtgggggagtcaggacccagatgggaaagaaagcatcttgccacactcaaatctcatcttttttgccatgtttgccccatggcatttctctcagcatcttcttgtgctttttccaaaacatataaaggacaattctactctggaaagtcactgggatactgttctctgagaacaggtattgagaagaagatggtttcctcttggaacttggccaactggctcacagcgaacgtggtgtggactcttaccagctctctctagtatgctaagggcccccaaccagggaccctgaaggcatctcaagagagcagtgtccaggtctgcccttgttggaaggaggatgatgtgaggagatcacctttattaaagctgcaggttgtctgccagattttcaaatttcaatgtaactttttatttaaccaatgctgattaatagtagtggcattgttgaaatccattccccttcatttcattttctaatgaaatttcggatttctacacagacatggttttctggcataaaaagcttgcatttgcaacctgtcatattgggactgtgcagaacttttccatgttttaaaactcaggagaaagaagtaaagatggtaagagtgcacttgagcagaaacaaagggctgtgatcccaaaacaggggacaaatgagctgcaaaggagagacaccaagagcggagagcaagaggcaaagtgatatgaaagactccaaagtgctggttcagagaaaagaaaaaaaagggacataggtcaggaaaggggagaaggactgacatgaactggcaaatggcaacagatataaaaagccagctttctctggggagtggaaatgtttctaagcatttttgttcatgttagtatgatttgttttttcctaagtaagcttgaaaatcatagagtgaataggagaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacctgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtcttacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaaagacaacaacaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagattgtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacatgaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaaaaacaacagcaaaaccccactgcatttctcaacttctgtagcagatggaggtggtcaagtgactaagttttagccaaagagatattagtgagaattgggagaaactttgagattccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcaggctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttaaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctcaaactcctggcctcaaacaaatcctctctcctcagcctcccaaagtgctgggattacgggtgtgacccagtgtgcccagcgctgtttactgaaatttttttttttatgattctgactatagctttaaacccaggctctgccatctccatgctgtttaacaagttctctgcccttcgtctgcctcaccagatgtattatgtataaaaaaaagtcacaacctagattgcagaatttcatgtaaatcgcttacaaaacaacacagatagaaggcagcaattggtgagtttgatctttggtgcccaaatacagctgtgctatttggtgtatacaaatgtcaccaaattcctgcacaaatttgcgggcgggataggggaagaaggaagggatgatgaaggcaatggacacaacagtctaaaaagttttaaaaaattgaatgtaggtaaaatagagctcagaattcctccaccatcatctgcatttgaatctggggagaagtcagccctcccaactttcacttcctactagaatagcaagacacactctgcctccagacagtgtggattatctgccacccgaactgaagtttcaatcactcaaatcctggtgtcatttacattgtttctactgggaaaggtcaggtgtctgcaggggctataagcaaagaaaaacccatcccctggaaccaccagtgtaaaggagagggaaggcgagtgacagcatgtgtcgatgctggatcattttcaggggtaacagaccactacatcctgaggctttttagcaaataggaagctgaaggacaaacatctgaaggagaaattaatctccgtgagtaggtgacaagctgcgataagcccttggggtgtgtgtcagtgtagcacagatgttagtgtgagaactattacttgattcaagggaaaggggagaagggcagggaggggggaaatgacaatgaaaaacaaaacagtgaaaaccacaatcatcttcaccaggcagctgatttttttaaaaaggcatatatccatcaaaggaacaaaacattaaaatacacccatatggcaaagacctggtgtaactggaattttcacctcctgattttgacagtgtaaatttgttcagcccttttgaagagcaatttggcaatgtgatttcagagccatagaaatatgcacatccatctttcaaatgtcccagctcttataaatgtatctttaaaaagactcaaaaataatttttttaatttatatgcctgaggtgtttatttcagcatctctacaacgagaaaaatgaaaaccgaaggtttgacatttgagacaatattaagtaaatcaatacatgctaatttaatgggatggtattaagtaaatctaagaccagcctggccaacatggtgaaaccctatctctactaaaaatacaaaaaattagccaggagtggtggcaggcacctgtaatcccagctactggggaggatgaagcaggagaatcgcttgatcctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacctgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtagagatcaaccagcctgaacctctcattttacgggtgacaagttgaatacaaaacttcggtggaattgaacgggcttatttcagtggaaatagtgagaaatactcattttcccaagtgcctattagaggtgctgtcattttccaggagccaatagaaaaacacataaaagcagtgcattggtgtgatctgggctgtttctctgaaatcactcagctcgctttcaactgctgcgttccacaacacaatgtggttctacattaaccacattacatcataaagagatcattaaatgactccttatggaaagggagggaagaaatgatgtttagagaacctggtagtatcggaggcatcatcctccttctctgctgcctatctgtgtcgcactcactcttgaggttatgcaaagaaaatgttgacaatttaggtgccagctgttgtttgacgaatagcaaataaatgactgtgaagtcctttggaaaacagagcaaaaccaaattagtgattcccctcttctgcctcccaacatcttcacctccagggccttctttacactgactatatttcctctgatttcattgtcccaatgagacagtaatcctactgagagaacagatagggttcttggagactagaaattatgtttattgaatggttaaggcattgtttttttatcataagctataatttaaagttactaagaaaacaggccaggtctctgtaatgtagggaagcagagatcagattatcttctgggggatagtggaggagggttgtaaccaccccaagtccttgagtgaggatggaacctagggctcaacagcagaaccctaagaacggatatttttgcctaggcctaagaatgtcatcagcattttatttatttgtttgtttgtttattgagacaaggtctgcctctgtcacccaggctggagtgcagtggcgaagtcttggatcactgcaacctccacttccctggctcaagtgatcctcccacctcagcctcctgagtagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtggtactctgtggtgagaaataagtttaagagataagtatgcagttatgaggaaaggtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgattggccaaggtggtgatgagagtctcttcagaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaccatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatatttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgttatcctagctcaggtcacagatcgctctggccattcccttttatctgccctgtgtgctttcttgggctcttcttctgttaacaggactctttttttctttggggaggttcttctccaccctctgcctagggctgtcaatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattggggctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgagagcaagtaaattccattctttgattagcaagtctgagtagaactctgccacttaaaacaaaaaaagtccaaattaatacatctttcattattggaaaggaatcagaatatcagtttaacaaggagcccattttattttctaaaattaattttgaaagaattttctcacatgggacttaatagcgcatattgactgatgtaatggacaatgccctcaaccacatttttacagtaaatgcagaagcgaatttcatctgatggtttctagtataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaaacttctgataaaggttgaataacaagtattttgagattctaattttcaaccagagctaacattttccactactaagtgagaaagggatctaaatgcttcagagactgggggaaattagaggagagcaaagttatgctacttgtatctaaatataagaccacttgtctctgcacagaattgacccctgtgggacctttggggatacctgcaagatatgcaggctgtttttttctatcaataaaccttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcctccccaatttcacccagtatctgaaccaatgtatccatcaaagtagtgtaatcagagagtctgcctagaaatgtattttagttaatcatggctaataccaagcccttctttctcccagaaatcaggatgatgtccctcttggaattacttttgatttgtgactggttttgatcatgattacacttccagtacctggcgtaatacctagaacaaactcccagtaaatatttgccaaactaatgatagaatcagatttatattttgaaatgagcactctgaatatattctagaaattgtattggatgaacacaaaagtagagtgggaatgcagatgaaaggctctgtgcccacccagaggagggccgcttgtggcttaattcaggcagcaataatgggaactgagagaattgagctggtttgagagatatttaggaggtcagttggtgttatgaaaagataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggcgcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaagatcaagggatttgccctgattcttggagtacttaagtgcaaattttgaagcatttcaattgttgaaaacatatcttttttttatatactttaagttttagggtacatgtgcacaacgtgcaggttagttacatatttatacatgtgccatgttggtgtgcttcacccagtaactcgtcatttaatattaggtatatctccaaatgctatccctcccccgtcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatggtgtatatgtgccacattttcttaatccggtctatcattgttggacatttgggttggttccaagtctttgctattgtgaatagtgccgcaataaacatatctttttttaaaacttagcatatatctatttgccatctcctgggtcaaaaagccaatggaaagctcaatgaaatctccaaatattcttaggttcaccttgacagatttttttctgaagagcaaaagagactataaaaaaacacttatcaaacatgagagattatgccttaaaaccacttaactcttatttaagatactactctgaaatatgtagatctgaaaacagggaagattaaaactcattttgctaatgagggcttagcccttgaggactccctgggtaaaattgtattatgggcattatctgggtccacactctgccctcaataacaagagaataaaactctcctctggtcataggtggagaattagcagcaccttgacattttgaaagaactagtctatcaaaatatataacagggttgtgacaaaagaatgaatggaaaaatcctctggtaggggtaattgcatatgattgatataacaaattatgattcagcatttactgagctcctacaggatgccatccattgtgtcagatccttctgcatgtgcactgagttaaattctcactgtaagattgacatagaccttatcactgaagatattaacaaatcctatcagttgagggaaattcaggttatgagaggtaaagtggtttatccagggttgtgtagctggttattggcagagccagaacttgaagctcgatcaactccacctataggtcaatactgtcctaagatttctggatacaagtttctgtattttcaaggacttcgttcatgggatttccccgtatcatgaatacctctctcttctgaatcatccctaatgcttgtagacatgttccaatatccctcaccttcaaaaacaaaaagaagatgaaacaaaaccttcttccttactgcactgctgttctcatttgctctgctccctttcacagacctacttcttaaaaaggcatttgtcatcaccatctccactttctcacccaaatttatttattacctttttgcttctatctccacattgccaaattcagtcacttttctgttcttattttattatgtctctggcagtatccaacaaagttggccattctctcctgcttgaaatactttttttaataatatattttgtcatctataacaccatatatcctcggtcttcctcttacaatccttttcggttttcctcttaccatctcctcgtagattcttcttctggaatacttttgccagttcttctgtctttgcttaacgaataaatgtagagtgtttctggaaatctttttctatatgctctttttaggtgacccctccagttgcttggccacctgtgtgagccatgtatctatgactctcaagcatagtctctcccctggacttcagacttgaccacccaacacccaaccaccaccttgaaatccccacttggatgtccagaagatttctcaaacttcacactaataaaacagagtcctagatttctctcctccaatcctggtccacctcccctgtgcttctacatctcagtaaacattaccactctccacttaagaaccttaagacagaaatctgaattattcctttttacttcctcatcaccatactaactcaatcagtatgccctattgcctctacctgtgaaacatctaagtccgttcactttttaaaacattttttaagttttttgttaatgcataataaatgtccatagttttggggtacatgtgataatttaagacattcatctaatttgtaaagataaagtcagtgtacttgggatatccatcaccttttaaaagtatttgtctttttataagctagaaacattcaaattattcttttccagctatgttgaaatgtacaatagattattgtaaactatagtcaccctactgatccatgtaacgctagatcttatttcttctatcaaactgtatatttgtacccgttagtcaacttctcttcatggtcacttttatacatatccatttctttcacccaagttaaagttactatcctatcctgcccgggctacacatggtctcctaacttcaacctcattggtctctttcgatttcttaaatataccaagcagattctttccagcttggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgctgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgggggaccaaattaccttttaaaattatatttaagcctactaaacaacaacttctgagttaacaatattaagacaaataaagaatgacatggctcacaattataaatcagctatggttaaagatactcttaaatagtaaaaaataatcaagaaaatgttatggatttggcctctcaaattatgaccctgttgaactatacaaaatataaacaaagaacaatatctgaaacattattgaaatttactttataactgaaagttagtataagcagttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttagaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataaccgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatctacctggaaatataagattaaggtttgcaaatccacttgggtaagtgtgtctcaagattttaacctatttacttataataattttcgtatttgccacctaagttttatacacaagactaccaaggaatagacataagttgcaagtggtcacagcttgacctgaaaacctatatcagtaaaccagtggagctctccttagaacagtaaggaaaagaagtgtaagatatgacttcagctgatacagtcagcaaatacttcttggatctatctgtcccatacactggtccaggccctggaaattgagcagaggtcaaataacccacttccctcatgaaacttacattgatggaatgaactactttttatatatttaaaataaaaataatatgaaaacttgaggtaatgaatgctgggcacagtggctcacacctgtaatctcagcactttggaagactgaggcaggaggatcatttgaggccgggagtttgagatcagcctgggcaatgtagcaagatttcgtccctactaaaaaaaaaaaaaaaaattagatgggcatggtggcacatgcctgtagtcacagctactcaggaggctgaggtggaaggattccttgagcccaggattggaggctgcagtgagctatgatggcattactgcattccagccttggtgatagagcaagaccctgtctctaaaagacaacaacaaaaacttcaggtaaaagtaaacctttctttcctttcatgtcagagaccacatattgcaatgagagtgaaatcacatgaaacttataaataaaactgcccttctatcagaatgaaagaaaggacaggaacaggtcaacttggttattttctctctagacccgtcattgagggtagccaccagagggctacctagccatacctaggtcacatacctaagtaacctgatacaaaactttctcctacctcctcctttttcccacctgtgaacctaacaccctgaaatttagcatctagaagtatctaaatgaagacagacatataatttttgcccctgagctcccacccttttggactggaattggacatatctctggagccacaaatcagagtcacatagatgtgactgccagcttttgtgacttggactcagtatctttttactgcgccaccttacgtttcactcagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtcttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatggtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggggagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagatccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttgagacggagtctcgctctgtcacccaggctggagtgcggtggcaagatctctgctcactgcaagctccgcctcccaggtgcatgccattctcctgcctcagcctcccgagtagctgggactacaggcgcccgtcaccatgcccggctaatttttttttttctctatttttagtagagacagggtttcaccatgttagccaggatcgtctcggtctcctgactcgtgatccacccgccttggcctcccaaagtgctgggattacaggcgtgagccaccgcgcctggctggcctctcttttttgaatgaggtaaaaaagaagcttgagaggcaaaacaaccaacagcaaataaccctagtgtattcattcattctcacactgccataaagaaatcctggagactgggtaatttataaataaaagaggtttaaatggctcatggttctgcaggctgtataggaagtacagtggcgtctgcttggtttctggggaggcctagggaaatttacaatcatggcggaaggcaaaggaggagaaggcacgtcttacatggtaggaacagaagcaagaaagagagccaggaggtgctacacacttttacaagaatttactcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactgaagaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtctatgctgtcataggtctttagattttagttgccattagcaggcattttcattcaatttatttatttatttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcaaagaggaaaactaaatcagtggacagagctaagagttagacgacccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaagactgaagcaaatggaatccatggcactttccaattttgtactttctctttctgtctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaaaaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctgcaaaataagagtaggatatagcaagacacatttcttattcttctgacaaggtagtacacagttcatcactttattgacaagatttattgatgtgactattgtgatgtcatcaacaatggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatgaaaaagaaaaaaaaaaaatagatgcaatggctgacttttggaaagttcccagcaaaaaaaaatcccggtggctttctgagtctcagcatgtttcttcttagttctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatgcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaactttacataggtaagtgaatcaagtatacttgaagagcctctctgttgacataagtaattagattattggacaaagatctgatctagtaattttcttagtatgtatgtgtgccaaagccaagagaggatatgttattaattagcaagcaaaatttctaacgtaggggttttcccacatcttaagtaaaattctcgaaacctggaactatggctggctctctggaggtgtttcataaatgcttgctgaattaatgaatgtatccacaggcatcttttaagtggctacaatgacattaagaagaaataaggtcacagagtgtagttgccgcctcaggctctgggaaggatgggtctggaaacaaccccacagtagaccatacacattgtttttgagactttcagctcatccatttggttactgattacaagacggtttttttttttcgtctcaaaaaatgctttatttctcagaatcccatttcagcattattggtttttccctcaccaattctattttcagctttctgccttttctcataatgacctgtaggtgataaattagtaataataaaaatcaataaaaaatgataaagttttttttgggggggaaataggaatgagtttcatgttaagaaaagaaggaacgttccagatggaattttctgtaatgttaaatgtacccatatggcttctgggaaatttaggggcatccttttgtattagggtaacctaatgccacctgctttaaaaattcatattaggaaatagccacattttgaccttcttgaacgatgttcctttatcaatcaaaaatataaagggtgttttatttattagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttggcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttctacatacctttctaatatgtgccaactctctcttcttcatttcacttgtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccaatgttgtacagacaattcttacaaggtcctgcagcttttctttcagtctttctttctttttttttttttttttttgaaatggagtctcactctgtcacccaggttggagtgcagtggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcccaaagtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctaacccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcgtggtgatgagcacctgtagtccaggcatggtggtgagcacctttagtcccagctactcaggagcctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgcccacgtcctccatcactgtactgaccatactctggtaattggctgtttatctgtccaatgccttccctagaccagaagctcctaaaggacagagcctgtattcccattcgtagtaccagcgttcagcacagtagctggacctgactaagcaccaagtaaatatttgttgaattaagaaaattaaaaaaaaagtgagaagtcaacagtctcttaatcaattgtaaagaaacactttactaggatgttctgacagctactccaaagtatcaaatattttaagtgaaattgtgatgtctggtgacattttttcaatattttagatttcttacacacaacttattttattttcatccactgaagctctcaagcatcttgttaaaataaaataaattagcttggtttctgtatgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttaaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctctccaccctgaccctccacgcccagatagacaccagggtctgctgttcttgtccttgtgtccatgtgttctcatcatgtagctcccacttaaaagtgagaatatgtggtatttggttttccattcctgtgctagttcactgagaatgatggcctctaactccatccatgttcctagaaaggacatgatctcgttcttttttatggctgcatagtattccatgctgtatatgtaccatattttctttatccagtccaccactgatgggcatttaggttgattcctatatattttttaattgacaaaaataataacccacagaatcactaagtaggggaaagatcagctgctgatattttggatgtacttttctcgagtccaaaggataattcagtcaacttaaaatagttatttaaaaatgtgaacagaatttgtggatgttgagacagattcacagatccttaggaaatattaaaacttttgaaaaatggccacaggctctgaaggaaaagagcagttgggcacttaatgccacaagttactcttataaatcattatgctaatgatagaactgaggtggttcatttgggaaaaaaattgaaataacatttaggaaaagctgagaggctggcgatcaccattatgaagagagcagcctgcactatgattagatgccaccaataaggggaccatatataactgaaggatgactttaggagtcattgtaaacctgtcttctgacagcagcttgagacaggaattgcattcttcctctaaatccttttaatttagtaaagccctttattgaaacatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttgatgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtacttcagtgttgtttagttacacagtttcgggcctcatgatgtgtttgatgatttgggagtgataaaatgagtcttaagtaaaaatcttttaattaaaacaaacaaaggatcagtttttatgggaaaccagtcagtcagcaagtacatgtgttttaagtccagaaggatgctcaagtggaggggtagagagagagagcccttgggatccagggattgtagagtaactgctcccattatgccaggcctagcagggctgtcccactgtctctgccctcacactgaccacttcattactggttgtttttactgagcatcttttcagagatttctgagaacatggtaattttcccagaccatacacctgagagatcaggtactatgttgcctttaaaaacaacaacaacaacaacaaaaacctttatatttttcctctttttatggtgaaatatggcatactttattatttggagaaagacagaaaacatggtttttttctcccacaggccacaaaataccatcttcctcttacagggaatgagacttttgtataaagaggcacaatttcctgtcccactaggagaaaattattctcttgtctgagtctcaacagaagcttgtgttagttgctgttataaattaaactactactcaacccagcagtcccattactgggtatatatccaaaggaatataactgttctaccataaaaacacacgcatgcttatgttcattgcagcactgttcacaatctaaaagacatgaaatcaacctaaatgcccatcaacagtaaacaggataaagaaaatgtggtacatatataccatggaatactatgcagccataaaaagaacaaatttatgtcctttacaggaacatggatggagctggaggccattatccttagcaaactaatgcaggaacagaaaaccaaatactgcatgttctcacttacaaatgggagctaaatgacgagaatacatggacacatagaggcaaacaagagacactggggcctattgagggtggagggtgggaggagggagaggatcagaaaaaataactgttgggtactaggcttagtacctggatgatgaagtggtctgtacaacaaacccccatggcacaagtttacctatataacaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttactctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgcccccatctccatgctgagtagctggtttataaatcaggagagacaatgctctttagatattcttaaatttgttataattctttcctgttatccagctcctcaacctcccttcccagctctgtctaccactttgtatcacttaagccacgttttatctacgtcttctctgtcactaacctttagtcccttgaaacaggcacaaccaaacaggactgacattttgcaagtcccttgagattttgcctaatccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgtctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcctcatgtggcaccttttacaagaggaagtattgtcatgctaacaaaatggtttcagatagtatgaaatcagtggtgagaagaatggctataaggaatgggctctacaattactgtcactctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatcatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttgaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtgtgttttcccagtctgtttcttacctttacattcccttaccagtatcttttgcaggaaagatgttaaatctgttgaagtgtagtttatcaagttttttctttggattgtgcttttggtcttgtagctaagaaaactttgcccaaacaagataacaaggattttctcctatttttttctaggcatgttatggttttaggttttacctttatgtctatgatccattttacattaatttttatatatggtgcaagttatggatcaaagtttagttacatgtggatatccaagcatcctaagcatcttttgcccaaaagataatcttttttatactgagttacctttgctgctttgttaaaaataaattgactatgtgtaagtctatttctggtatctctattctgttctattgatctatatatacttatccttaaaccagtaacacgctgtcatcatgactttagctttataataaatcttgaagtctggtaaattaagtcccccaatgtttttctttttagacattttttttggctactgcaggttctgtgtattttcagaggacttttaaaatcaacctgtcaatttctaataccaaaataaagttctttagaattttgattgggattctcacgaatgtgaagatcaacttggagaaagctaacaacttaatattgagtcttatctctcaacttattttggttctttaaaacttctttcaacaattgtttttcacatagagatcttgtatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggttcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgcctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagatagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaatgaaaataataataaaatctatttcatgaggttattgggatgttagttttgttaatatgtataaaaacttggtgccttgtacataataaatactcaataaatgtatttaaattttgaacaacatatttgacatattgtgatttccaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactatattcatttataatattattaaaatcaatggatgagtcattggttaccatgtgtattccggttctgaaacacaccctcctcttccccagccagcactcacctcagtgatacccagtctattgcaggttttttatgcattttctaaattacatgaaagcaagttgacattctttctttgtcttagtcttccataccattattttggcatgtttaaagtatcatccatctgattatgtttggaaataaaagcatgaatttgttaaagacatgtaccttccaaactgcacacttattgtgttttcactttcttatcattgtcccttcattagagaaaaaaatctattctgtgaagtatttggttttttatgcagtctgctctgctctaatatacacaaacacctgattctgcaatgagaattagttggtatgtgattgttgagcagggaaatagtactatttcacagaatttcctttagtttatatatggatttttcttggctgaagaagccagattactggagtaaaattataatctccagcaaaaataaaaaaagaaaagtccacagctcagcccctcctctaaagagttgtacagcgcagccttccacggctcatagcttacagcaggtctcccttccctgccaccaccctcacagcaaccccactggctgagcactctgtttttatttattgtctgagcactcatcagtgcagctctgtttaacatgttacctgtatttccacccaaattttttttttttttttttaagaccaggtctcactctgttacccaggctggagtgcaatggtgcaatcttggctcactgcaacccctgcctcccaggttcgagcgattttcctgcctcagcctcccgagtagctgggattacaagtgcccgccattatgcccatctgatctttgtatttttggtagagacagggttttgccatgttggtcaggctggtcttgaacccctgacctcagatggtccacccacctcagccttccaaagtgctgggattaattacaggtgtgagacactgcacccagcctctaatattttttagaacatccattgtggtagcctcctgccatgctgaacagttggcctgggtggtgcaagttatctcccaattattgggaggtatcaattatcatttttgtttggactttacaaagttttataggttctaagtgatatatcccttctgcagtttttctcataagttctgtttatacagtatgtgattttgcagaatatgagttttttgagattatatatattgcaatatcatagaaacctttttgtttgataatctttgcttaaaataacctcatttattttgtacgaatgtacaaaaataaaacaatgtagtacttattggctgtttttgtggactgaggtagagatgtcaagaagttcaagccaaaaaaactgaaaatagttaacagaaacaggcaaatctcatatatcttgccctgattattttttcattagagtccctcctattgaggaaggttcattagcatgtgatgaaacacattgagggggattaattaggaaatataaaagagtctcaaacttctgatataaggtaaaacacgttaattttatgtgtctttaaaaatgtaattagaaccttctgtttgtcttttctgagacacgtatttaaaatttccctcgactcaactgataatctgtgattttgattttcatcccaaagtgacttttaaaaaagttttggggttagggggatgtggtggctcacgcctgtaatcctaggactttgggaggccaaggcggggcagagggcggcagatcacctgaggtcaggagttcgaggccagcgtggccaatattacaaaaccccttctctactaaaaatacaaaaactagccaggtgtggtggcaagtgcctgtaatcccagctacttgggaggctgaggtaggagaatcacttgaaccccagggcaaaggtattagtcagcagagattgctccactgcactccagcctgtgcaacagagagagactttgtctcaaaagaaaagttttgggtgaaaagtagaaaaaaagtcataactttgtgtagagacttttccctcctgtaattctttttattatcaaatatcaggtattatagggtataagccagtgttcttttttatgatttccagaagtgttaaattttccatgtcttctgcatttgaaagtaataggtttggaaagagaaaagctgttcattcttcaagtacatgtaagtttaagtaccttgcagactttgttttgcaggaagcttccttgccttctccccatatcacctctctgcacctcttcacacccatgagggtctttatagcagtgcagtccataaattgttttgaggtaccaataccagtttcttggatattttcttacttaggaacataaatacttaggctgccattgcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactctgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagagaagatatacacatggccaataagcatatggaaaattacccaatatcactgatcatcagagagatgcaaatcaaatccacaatgagataccatttcacgccagtcagaatggttattattaaaaggtcaaaaaataacagatgctgacagagtaaagggaacgctcatacactgctggtgggactgtaaatcagttcagccgttctggaaagcagcatggcgattcctcaaagaacttaaaatagaattatcatccaatccagcaatcccattactgggtatgtacacaaaggaatacaaattgttctatcatgaagacacctgtacacatatgttcatcatagatagcactgtccgcaatagcaaagatatggaatcagcctaaatgcccatcaacagtagattgaataaagaaaatgtggtacatatacaccatggaatactatgcagccataaaaatgaatgggatcatgtcctttgcaggaacatggatggagctggaggccattatcctaagcggactaacacaggaacagaagagtaaatactgcatattctcactcataagtgggaactaaacaatgagaacctatggatacatggaggggaacgacagacactggggcctacttgagggtggagggtgggaggagggagaagatcagaaaatatacctatagggtactatgcttattacctgggcgatgaaataacctgtacaccaaagccccatgacacgcagcttaccaatataacaaaccagcacatgtacccctgaacctaaaatacaagttaaaaaataaatacataaaaatttaaaaataaaaaataaaactgcaaacgtgccctgctttctggcagtaccccattccctgttccttagttttctctctggcacttatcatttatctattttattcattgtctgtctcccttcactagaggttcatgagggcaaggattttcatgttctgtccactgctatgtccctaacacttaaaaaaaggctttgcattctatagtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctgctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctccttggttcaagcaattctccctgcctcagtcacccgagtacctgggacaacaggcgcctaccacaacgccaggctaatttttgtattttttagtacagatggggttttgccatgttggccaggcttgtctcaaactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccattctgagtagcgtgatgaaatcttgccctgtcccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagatttggagctgccaaagagaagccctaaagtgcttcctttgagtgaaaactcttaataaggaaagaaaaacattgaatgctgaagttgttagatcttctatctgttgaactgtgaagaagaaaaaagatatttgtgcatagtatataaagggtttcgtactacccacggtttcaggcatccactgggtgtcatggaatgtatcccctgaggataaggggggattactctatgtattttcgtatccttacatcacttacattatttttcctcagccttgttgaggaaaataaaaacacagaagccaagaaagaaatgagcaagcactggccgggcacagtggctcacacctgtaatcccagcactttgggaggccaagacgggtggatcacccaaggtcaggagttcaagaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctcaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagattttcacttttataagataaaagagcttattcaaatccaagtctgtttgaacctgacaaggaaagccttctctaaatagagtatctgaatccctccctgctcgaaagtctcctttatacgctcatgtttcaaaaatttcacattttttgagatatagatagtacccacccacatcacctctgtttttatggaaaatttacacttaagtggcaattattttaatcagatcgacatcctagagagtgagagttcattgaggaaagaaggaaggtacatttttggatcataatgaggagagatcttgatatttttgaaatttgttttgtcttcccatggtacaaagttttaaaagtacaaaaatatgaacagtaaattctcccttctctcccatccctgtctctagccacccactcctcttctgaggcaagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagatgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacactcatgtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaacctttttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggcttgcaccaccacacccagctaatttttatacttttagtagagacagggtttcaccatggtggccaggcttgtcttgaactcctaatgtcaagtgatccacctgccttggccttccaaagtgctgggattacagatgtgagccactgtgcccagccttcatcttcatcttaaaacttcttccatgttcgctgtggctggggacatgatattcctctttccctcccagttgctcctaaggatgagcaaaaagctcttttcacgtcaggggttgtaccgccaatcactaaaaggaacagttgaaatatcaaacatggagaaattgcagtgattacaaaggaatgcaatggggcaccatacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctactcccatttgaagccaccaagcctgtttaatattaaataagcaaatgcttcaagtactatggtgacttcttctgtgcctttgcaactaaagccttccaacagcagaggggagaaatttatatctgttatatacatagatgagtaatttgggaatataaaacaaatatccttcttagaaatatttaaacacagatgcttgattttgtctgatctttctctctcttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgaatatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagacgcatagaaaataaaatattttaggtaatcctaagatagctcttccgcagccagggcaattgggctatgtgtctttgggttgattgttagctctgtcctaaatctctgaatttggagaaggaaaccctggatttgaattccagttcctcaacttactggctccatgttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctatgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatatatcctgatatactttctcatctataattctgtttctgtgcactagtttatatatttatttaatggaattatttttacagatttagtcagattttagaacacaaagcaagtggatacttagtagccataggggaatctgattttgatgtctcctacccaaagtttattcatatttaatattatatatacataagtcttattctttctcttcgtcctttttttttaaaggcaagatctgccttcatcttcggttttctttagtgcttagaagattgccttgctagtgataagtatttttgcttaataagtatatcttgactgtgaaatttgtcaccagttttgaaaggaactctggcagcaaatgaacaaacttaaatccttgtggccagggatcaaaggcaatctcaaaccgaattctataataaagagaagtttggagagagaaagggagtttagtgtaaactcaacttttgaaatccaaaggtatcaggctatcatgggaagagtgtgggattcagctttagccctggggtcacaaagtcatgggtatgctcttatataagtaacttaatcagatctctgtttcctcatctgtaatattaattcccttctcctatttcatagaaatgcttaaaatttttaacagaggtaatatatgggaaaatgctttgtaagctataaaattagtgtacaaatattagggtcactgatactctgtgacgcaattcaatgatttggtagaagactatatatatatgtgtgtgtgtatatatatattatatatatatatatatattatatatatatatatatatatatattatatatatatatggccaaccatatatctattagtagctctctctatatatgttttaaagccaggctggtcttaatcttgtctattgaattcattttgacaagaacagtgtaggatccattagtcctttacaatgaagaacatattaggtgagtcaatacttaattccaaaattttactttagaataagagggatgtctaacatcaattgattgaaggctggaggaaagagcgtggagagaaagaagtaacacactgctctgtgtttttgtgcctctgtctccagaataaaagtggacatgcccttcttcctccttacctctctctctctgtatccctttcagtacatatgtccaacactgccatacacagcctcgctgaaagtatcaggcaaagggagaaacagtgagcattcctacctccagccttgacaacaactatgaagtgtgttgctctaagctctgatcataagggaattagaagcactatgattttttaaaatcaaaatatgcctgtagctccaaaaaagaagaatttgactatagggtctcagctcactgctaggagaggtgtaactgattaaactctggtgcagaatgtatcaggatggaaggaatctgagaagtcaccaagttcaaatccttactttcagtccacagagtcatcctgctgcatttcctttttatgcctgcaaacaaaatgtttctggaactcatttattgtcagtgagtgctccctgggctctgaagcccagagatgttcctccataactcatcagaggcttgggtcatttctgagacaataagttactgctaggtcactgaacatacttggggtaggcagtggggaaggggattctgtgataagaaggtgatcatgtgttctctatttataggaaaatgaatcattctcagggtgatgagcatgtgtcattaaactgttttcctgatcatgaccttgcaccaagctgtttgccctctttgccctgttccctcaggctcagtggtcagggagggtgggccagctggccgagatgtgcagtccagtccagagttcaagaacagtttgaactgtgagactgagagccaagctgactaggtcagagtgagaagccattcctcagcatatgggagctgttagttagtgccctgaagctctctagttatttggggaaggaatgggagaaagcacttagatccctgctgggctcattacctttaattagcttgcttggtctggtggctactgcagagggggaaatctccaaaaactgcaaaaagattgtgcatgatggtgggggaagatactttaagaagggaagaagactctgttgagcttccacaaagaacaggttgttcatacctgaatgcacacagggaatgcacaaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttctgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtgtatatacgttacattttcttgattcaatcatccattgattgaatggtgtcctttgacttatcaaataaatggtgctaggaaaattggctagccatatgcagaacaatgaaactcgttcccctatctctcaccatatgcaaaaattcactcaagatgaattaaagatttaaatgtaatacctgacactataaaaatcctacaagaaaatttagaaaaaactcttctgggcattgcctagggaaggaattcattactaagaccccaaaagcaagcaaatgcaacaaaagcaaaaataggcaaatgggacttcattaaactaaaaggctttggcacagcaaaagatataatcaacaaagttaacactcaacatacaggatgggtgaaaatacttgcaaagtacacatccaatgaagggctgatatctagatatctagaacctatgaagctgtttttaagaacagaatgaggacatgagccaacacccaggattccagtggaaagtgaacagagcaggcacagttaatggaaaatgaacagagcaggtacagttaatggaaagtgaacagagcaggtacagttaacgtcatactttacctttttccatttgcacttcacgaagagatgagctttgatagttaacttctctctctttttctctctgttttcttcttgtgcaaactgggtgatgacattgactctcttcacaggaaagcactaagtgaggattaactaggtaatgagagcaaattggaagggtgatggagatgctccgcaaccttgctgatggatttctcccagcgagagaatctcttcaatgcatctttcatctgtgtcttacaggcagggtgtaccatcgttatctctgcattctgcttaagccatcccctccaaaccctgcctctaaggagctttggcctattccttgaaaggattcttcagttatcccaccaacaatcagaggcagcaggactcaatatccccctgtatggagaaaaactgagacaggagattgggctaagttgtcagtgattcacccccattcctgccctaaggaaaggatctttttctttccttttttttttttttttttttttgagacatggtctccttctgtcacctagactggagtgcagtggcatcatcatatctcactgcagcctctacctcccaggctcaggcagtcctcccaccttggcctcctgagtagctgggactacaggtacatgccaccatgcccagctaatttttgcattttttgtagagacagggtctcagcatgttccccaggctgggctcaagcgatctaccctgctcagcctcccaaagtgatgggattacaggtgtgagtcaccatggcaggccaaaagcatcttctcaaaaatctttcttccaaaatgtatattatacaaactttctggagaacaatttaggaaaataagtattcaaaattcttagaaaggtgcatgattcttgcccactgaattccactttcagcacatgaccattagtctttcatttcttcttctcttcttcacaccagagtgtattgccttcaacaaagaaactaaccacttttagacttgtaattaacctgtcccttcccctcatctgcccacctgactactgaaagtccccagagtctgcttcttagtgggacaccagccttctgcaaggcacttattctctggttatgaacctgtttaaggaaatctatatatttgcacagaaccatggaaatatagatgtgaacaggcttaagtgatcacaacccacattttttttttttttttgagatggagccttgctctgttgccaggctggagtgcagtggcgcaatctcggttcactgcaacctccacctcctgggttcaagcgattctcctgcctcagcctcccaagcagctaggactacaggcacgcaccaccatgcccagctaatttttgtgtttgtagtagagacagggtttcaccaagttgaccaggatggtctcgatctggtgacctcttgatctgcccacctcagccccccaaagtgctgagattactggcatgagccaccacgcccagccagcccacactttttatcagatgaggaactagagactctgagaagacaggtggcttatccaagagttcatacttattcaaggctacagaataaaccagaatctggggcctgtaactcccatatgggcccttctcgagttatggagacttaacggtgtgggacacaaaataggaagaagtagagtaaaactttataaagtaggaaaagaaataatgtttgtactatgtataatggcacttcaaaatccaccattaggagtgtctacagtttcctctgcataatttagaggctgaggccatgtacctcaattcagtccagttttctatccaagaggtgcaagctctaaaataaaggaaaggaatattctttatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtattgcatttgcaccattctaaaatcaatgtgtcccttgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttgtccagccattaatcaggtgtgtctgtgggaatgtttctggatgagatgaacatttgaactggtagattgagaaaagcagattcgtctcccctatgtcagtggacctcatccaatcaagaccggaatagaacaaaaaggctgagtaagagggaactactcctgtctgactgctttgagctgggacatcaatcttctggccttcaagctcaaatgcaaatatcagctcttcttgagtcttgaggctactggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctacatatatatatatatatatatatatatatacatatatatatatatatatatatgaacagatacatcctattggttctgtttctctggagaaccctgactaatatacagttatgtgtcacttaacaataggatatattccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtatttgtgtctctaaacatagaaaaacacagtaaaaatatggtattataatcttatgggaccagttgtatatgtggtgtgtcagtaaccaaaatgtcattatgcagcatatgactgtatatatacatttacacttaatcctcacaaaaaccctctgaaataggtactattgttttgattatcaacctaactttaaaactgggaaattatacatagactggttaagttcctcgcccaaagctacacactgcatctggaaggagtctgaattcacccagataccgcgtgctccatctgtttgattcacattctcctaattgtgtcccaaaagcctgaaacatgtgcatattctttgatctagccatcttatcctaagaatttaccctaagtaataatcatggatgtattcaaatatatcgcaaaacatttataacagtaaaaatatctaaacaacttaaatgctaaacaataataggcgattggttaaatgttctatgatgtagttactcagtgaaatactaccttcattacaaaccatgccctcaaggactatttatttacttgggtaatcattcaagctatatagatgagagtaaaaggcctgttacaagcctgaggagagatggtaactaaatatactgtatgctcgatgagaccctgaaattacattttaccatgtttccttaggcttgtagcattccatttttacttctattctgaagcagaaaaaggagattagataaaaactaagaaaaccttaataaaggccgggcgcagtggctcacgcctgtaatctcagcgctgggattacacacatccctgtttttaaaagtgaaatctgccttctatagaacacattcccccacagaaatatactacagaaaacagacctaataaagtggagttttgttcaaatgcttccctcacaatgatgctttaatttgctgaggaacatatgattgatcctagttcacctgctgaacatgcataggcagtgtgcatctctagcacactgattaaaatgaatacccagaggctcaacatgatttcttattaatcagaacatacacaactttgtgaaagggaccttagagccattctctgccccagggtgaactgggacacaggtatagaaacctccaggactctgttggaagagtttttcttctaggttttttttttttttctgttataactgtcctttccaagattaaatgatgcctaggatatcacatcgttcagaagaggttgaaagagggagttatttataaatcctgaaggttctaggaggtttgggcttagaccactttggactcagagaaggctgtgaggtaaggcatgttctaatcttgttgatggaagtcctaatgtgtcttagaagatttctggtcatcactgtctttagggactcagagtcttcctctaagttagtttcaggaccctttgaagtattggcattgctggctcagtccactggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttagcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctggttttgctcctgtttgtggtactttatttctccctgtagcaggagagtagtgccaacgtgcctggaaaatcaagtttcaaacctctattgcattttaagccatgttttagaatcttagggtcaattaatattagagttcgacaaaatctctgctctcaaacaaaattatatacaaaagctcagtaagtaaaccaggtaaatgttaaggtgcttcggttgaatctaggtttaggagtccagagaatctaactcaaacctggcagctggaggatacccaagaaactccctgggcttagtagtgtacagtgcgaaaaacagcgatctcatccatgtccttcattttagggagatgatacctaaactttgtgggttttatttcaaagtcacatgttaattagtggcattgtgagggaagcatttgaacaaaactccactttattagatctattttctgtagtgtatttctgtgggggaatgtgttctatagaaggcaggtttcacttttaaaaacagggatgtgtataatcccagcactttgggaggccgaggcaggtggatcacctgaggtcaggagttcaagaacagcctggccaacatgatgaaaccccgtctctattaaaaatacaaaaattagccaggtgtggtggcacgtgcctgtagtcccagctacttgggaggctgaggcaggagaattgcttgaacccggaggtggaggtttcagagcaagactctgtctcaaaaaaaaaaaaaaagaaagaaagaaaaagaaaaaggatgtgaaaggaaagagtttgcaaaaaaaaaaaatgcggcaatcacaatacatttatgtctattcatattatttgaatttgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacatacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacactttcgtgagtaagttgctaaagcgtcagtaaaacatcatggtgaggcctctgcaatcagcctgcttagatttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgtcgttgttgtttgttttttgtggttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatcctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggataggaaaaatagcactagtatcaactgccatacaattatttagtcacccttgggtaactaaacagcataggtatgttgatcaaaatgcccttgagtaattgtcagtggaattttgaactctccccaattcaataagatactgctgcaggtattggtgaggtacagggagcatctaaatggactgtctttcattgtctttcttgagggttctaattctttggttttctggagaatattataggatagaatgtatatcagaagtgagacttgggagacctgtgtgacctcccaagcatgacaatattcacagatattcagatccatagaacacttcaggaaattgtctttatgttcaaagatctcatagaacatttagttggatacacttcccacacacatctctccatttgatatagagtcattatcttttcaaactttctttttggtcttttacagaagaacctgttaggatattctcaagatttgttctagtcacacgggggtggagggggagggggggtgtgttatagaagtagctctagatcatttagcttaagagttaaattttttgcaaaaatactttgtggtggatttctgatgccagtccgcataggacttttattattgtaatagtgttttgtctttcttttttaagattaggaaagtatattcaccataatatttgttgttaatcacttattttttatgcaccttttccaaagcaactatattgtccttatcttgaaaaatgaaaataatagcttccagataaatccttatgatagttttgctatcactagatagtggcagagggaaacagaggaaaaggagatctatgcattgtctttgaaagtcaagattattatactaaatgtttttgaagcattttgaaaatacagcgatatttacttataattctcaactatattacagttactggatctaaatgagaagtttgttcatctgtaaagtatttgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcatggcagttttaaatgtattaaaatgataagtctataaggtatcttcttaagtaaattctcccaagtataacagatatcagaggtaatatacacctacaaataattattgctaaagtaaaatttgtaaagctattgactgtcagtaaatatgtttaagaaacagtttttcgtattactctaagattgttcttaaaaccagcattgcagttcagtagacaagtgcagatatttgaaataagatgtttttatactacctatgtttaaatttcatgagcttcatccagcactggattttctggattctgagatatgctattcacatttcaacatttatgaaaacagaatacatcttacaattaatgtgttcatttaatgtaatcatacttcttgttttcctgaaactgagttggaaatcatcatggaaaataggttcttctcaacacaggaagagttctcagctattgtatagttgtgtttttgagaacatgcttcagcacttgagagatggatttcctagagtttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggcgttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagaccccaatcaatgtgccctataaatacccaagtctttaaatacccttagataataaaggtaaaagatgcaagaaaaagaggactgggagagtgggccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagttggtcaatggcatcagagaacttaaagtgcctgatgctgatgactcttccagaaggcaatcctcttatgagggtcagggtctagagagtccacgttgctgctcgtactctctgtgtttaattccagctaacatgacaaagtgcaagcgtatgacaaggactttcagtgtgaccatcagctggaagaagccaagtgcgtacagctcccggtggggtggcacatgctcctcttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagtttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaaactcccatcaatggatgtggagtgtttacaacatttttgctctcataacagtgcttgacaatgtagggatttgtcaggttttaatccaaatagggctttatgatacttgccattatactatcagatactttttcccactgatatggtttggctgtatgtctccacccaaatctcaccttgagttgtagtcctcataatccccatgtgtcaagggcgggaccaggttgaggtaattgaatcatgggagcagttttccctcatgctgttcctatgatagtgagtgagttctcaggagatctgatggttttataaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactaatacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtacagaaaaataaagatttgacttgcctactcctggcataccatttgtaggttctggccaacatctgcccttctctgagcctggagcttctctctttcaaatgggagataattgctgggcagctagagctcacaggcacgccgcatgatgagtgaggtcatgttaataaagccctgggaaagaaaagcaatgtgaaacagcagggctattaccgttccaagacgattttatacaagtgaagcttaagttcagtgtgatgattaacaagctattagagccaagttattgattcctctatctttagagtagctaatgcagtgtgcaccaataggccacagaccccaagctttccttcttcctgtgctcctgttctttgtaatgatgctttccttaggaaaatgaaaatcacttcgcatacacagtgcaacatctttaaggcaggtgccagcagagaggaaaaacacctaagctgattttgtgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttcaccctgaagcagctagttttgctaatatgatcatatacctatccacacatatgtatatgatcatattaaacatattagtttataacttgttctttgttccttttctaacatactcctcacaaaataatatcattgatagtttcccatttcaattaaaacagatatcaatataatttatcagcaaaatattttatggatgtgtgtacagttttggttaatccatttaaccaaaatcctcttgatgaacacagagtatttacaacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaaagtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaataactaactatgatataatcaggctttcttgcagttttgaaaaagaagccaaactttcacatggtttaaattactctctcatttacactctccatgtgtgagatcacctgggaagccctttggagatgcccccagtgacccagtacaagttgtcaactgcactccccatgaaagagagattgttctggtccaaaccctatgctctagaggagcatcttggaaacagcactgccctataattgatattgctccattgggtggcctgtggtattcaattcactggaaagtatcaatccctttgccttcagcaataatattttcacagttttgatgtgttttaaaggttattgtctccaggacaggtaattgaggaggcctcacacttcatcagaggccatttcatctttattacacagccacacacaaggcagcattttctcctttcactgatggattatttcaagatttataaggtctggtctacatgaaagcaaacacatgtttgggtacacagtcaaataattcaaagatatagggtcagcaggatcctaatattaaagtcaggacttccagcctgggcaacaaagtgaaatcttgtctctacaaaaaatacaaaaaattagccgggcatggtggctctcgccagtggtcccagctacccgagaagctaaggtgggaggattgcttgagccccaggaagtggaggctgcagtgagccatgttcatgccagtgcactccagtctgggccacaaagcaagaccttgtctcaaaaaatgataataataaataataaaagtcacaactttttcctcttctacctgtgccagagacccactacctaacccacatacacacagacacacacaaacacaccatacacttattcctttcttaaaatgtggctttcaaatatttgctttgcatgcagttttctctgaagatatgaccagtttcaagattatctactctaagttttctgactggttgtcagtcagtcagtttggaaccctgccataacatattttcctcaaattccttgcagatactggaataataatgaatgggaatgttattttgagccgatatttggaaagtccttatttggaattctacaagtttatgtctcctgcccagttcctaagccctctttctagataaccatccagaagataatcatccagcagctatccgggtacattcggctgacttggttagttgggtctaagcagtatatccatgagttctaactcgggtttctcaaactctttttcctttgggtttctcagactcttctctcaaactcaaactgccttctccagtccattgctaaagcttgtatgacctttgctttccctccatttcttgacttgtggcatccactagtcctacattgtaggactagtgtgagcaggtcactcagcctgaaagcactcaccctgggcctctagagctaagttgcctcaacacacttcactatggcttctcagagcacactcaccttgaatgtttagaaaaggtaatctttttggggttcaatgagatcaaaagcacggataccaattttgggatcaggaatcaggaaaatctgggaaatgaagaacgaaatgaggccttaccattttgatacaaagttcatattcaagtgagtcaggagatctggtttaagttccagatctgcctcttactagttttagaatcttgggcaattctaggctggacgtggtggctcacacccataatcccagcaatttgggaggccaaggcaggtgaatgcttgagcccagaagttcaagacatgccttggcaacataggaaggccccatttctacaaaaataaaaattagccaggcatggtggtgcattcctgtaatcccagcaatatggaaggtgggaagatcacttgagtccaagaggtcaaggctgcggtgagctatgatctgccactgcactccagcctgggtgagagtgagatcctctgttaaaacaaaacagaacaaaacaaacaacaaacaaacaaacaaaaaaacaaaaaaaattggagggaatttagttcatatatttgagtctttgtttcctcatctagaagatgtagtaaagataaatgaggtcatatatgattgtccctggcataatattttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggaatggcatttgcatccgttgccaatatccatagaacaaatgccttcaggcaggagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccaggatcagactctaatttgcaatggctatgtgtctgtttgatttagatcaggggttagcaaactgcagcccacaagccaaaactacctcccccatctatttttataaataaagttttattggaacacacccatcacacccatttctttatatctgtggctgctttcatgctaccatggttgttttatttaattgtaacagagatctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtatacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatggctataaagaaacataaaggtgatttctccaagtgttatgctaggtgagaaatatttaataagtaagagcaatcagaattggtcccatattgagaaagtctgttttggagcccagactaaatagactgtgcagtgagaaatgaaaggtcaatttaggtaacttcatttagggcaaaatcatgacttaggaaatcatgactagataaatatccagtgaagagcagggagagaagattcatcaatggccgtaggttgctgtgaactacagaactgaaacatcaatgtatgaataaagtgctgtattgatggacagatgtgtgcatttttatgtatatgccataaaaaatctgaatcaatttctatttgaaatagagaaaagctagttcagatgttagaaacttttctgacgcaaaatattgtgtaattcataaacaattccttgtgttttagtttacagtatgtccagaatataggacttgcctactgtaatgtataaaacaaaagaacttcaggttgatttatttgttaagtagtagacattctcctaggatgtttatgtttgtgaagatgataaatggaagaatacatccacagaaaatgtagacacaggcccttctctcccagtctcaacaccacaccctacacacacacaatgccttccttctaaccttgtctatactgtctctgcaacacacaaagcatatgcccaggataagcttctctttcaaccacctatcaggctttcaacatgtggtttgaaaagatagtgacattgctatgctctgacatacaccgtaatgtcagtacagcagaagcaagtggaagattctacttttccgataaagatcagttgctgtttcctgtcttgaagacgaaagttgagcaaaagcaaaggtcatctgtgtttatattaacaatgtaagagttatactacattttcgcaacaacatcaggtcattatttatccacttgtcctttttttttttatcattcctttgaactgcctgcatttgcttatcgtgatatttctcagtctgtaaacagcccgagtagctgttctatttctctaaatagagtcttaggtcattttattatccagaattgtaagtcatcagaatgcacccatctgttgtccttccacatctgggctaactttaactctttaagcccatagaaaaagtagaaaagccattgtgatatgagtttgatacttttttcctaccatactgctttccagcatatggttttccctgaaaaatcacaaggaaatatttacaaatatcttatttttctttggacatggcattaaacgtggtagatcctccatctccacttggctctttctgattttctgttaccctaattatccttcctgcgatcacagctgctcagagcctcttcttaccaatttaaaaaacctctaaagatgtgacggctgcctttccagtggccaacaagcagatttccatagcagaggagctgcgactggggcagagagccaaagacagcttgtgccaacagccttgtcaatatgccaatcatcttgttacagtttattacatgcgtgacttgattttcttgcatgtgcgttttagaggtaacaacatattggtaaacctgttttcaatccttttgattaccttcaatttgatagctccttcagtaatgaagaaaaaaatgggctattgtgtttgaattacatttatcaaatgattctaagattgttctaacgtgtgcgacaggataagctctcttttagtcaccaattggagaaatatgctcagtgtcaaggaaatggagaaatgcctcattatttatgttgactaatgtataaatacaatatgaacaggggcggtttcaaccctgcaaacgttttcttccaagttgctctgtattttagctagactagactagattgttcagtggtcacaaactaccccaaaatcttaacagtttacaacaacggaagtttattttctaaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccatttcggtggtaaagcaagtcaattcaagtctgacttcagcatctttgggaaatataattccaccccaggaggggaagcagatatgggtgaaatgtaataaaattcacctctccataaagtcctagtagcattgttttatttgagtgaattctttttttttttttcttccttacagatcctctttaaaacatcagcctggaaacagtatctgtagaaatcagttttgttagttctaaagcagggcttcattgttgggatgtgttgtctgccttcgttagcagatttcaatcatagccctaaatggaagacacattttagggctgttgctgctatagaactccaggtctttctgcttaacggtttcacacttacgtgtgaagggaggacacccttggccaaaagaaccaaggctgctcagttagctgctggttgtcctccagcaaattcctagaactaaatacctggtgctgaggtgtcacgactcagcaagtcctagaacctgtgcttatgacagcactctgataattcccggttattgcatcactccctgatggaaacccagcttttatttcagcaaaagtaatggattgttccagacccctgacctcccttgaagatgtctttttgttggatctggccctgtatattttccagttggttcaagacctagagaaatttctacagactctctcataccaggtaggtttttgtttgtttgtttgtttgttttgcttttgggataggacctagtcatattcagtccacattggaaagcataaattagtgtaacatacataagcttgttcattccactccatgtgttaggtttttgttagtgaacactgactgcaaaaataccaaggtatagccttatgcaagccaacatagtcacgttggacattagtgatctgagggtggaagtgaaatgaagtacggttttttttttccaagtcaactaaacgaacaggctgtatgttttacaatatgaattgggttgtgatatacaaagtgtttatccaaagttaccctcctctttgttttttagaatgacaagacccaaatgggagaattaggccagaagcaacaatgccctcaggcttagtgaaattgaccaaagtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgtatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacagtgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatggtgtttgtgcatatattttgctttttctaatcttatctttgtagttcaaaaaggttaaacctgaatgtgatatgtgtgtgtatggaaactgaatgcactataggttcaaataggcaaggaagttgcttagtaacatcctgttcttgactgtgctatcataatttgcattttccaataaagtgtgtttccagccttaggacagtgctactattattgctggtggattttgtaatgtaagcttgactcattcagtgtcaagatcacctaaggccaaattcccattccacacgaattctctttcaagggatgtcctacccttcaagatgcccttaagaattctggattccttaaatatagaactatttatgcttactcataaaacagggaatgttataatatttctctgcttcactgtgtccaaggaagtagagaaatctggtaccatatttatgagcagcaataaaccatgtgttttgctttttcctaaaacaagcctggcaaactgtttaagaacacatgtgcagagcttgggcacagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtctaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgttcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatattatcacacaaacacacacatttagagaatgaatgtgaggctcagagaagttaaacacattgcccatgatcacagaaccagttagtggcagagttgggatttaagcccagatctttctgattctagagcgtatgttctatctatgaagctcttaccgattttattttatatcaagtgaactgtgtaatacataaagtcactcaggaaacagtactggatggggattatgatactaggcagtgcttactctagcaaataggtatcagagccctggcataggtcctcacttttgctaggattctgtcctactccacccttgctgataaacgggaagccacacgtcctggtccagcacttattctcaggcctcccagggacactcactctccatcacgtagtctcttccctaagtagtctgtgtttccctctgccttgcgggtaacttcatctgtgtgtaccaaacctgtcacccctcttagtagtcctcaaaagacaagacttcaagggagagttaatattctcagagttcatcagaaatacctgtttccaaggtcaagacccaccttagaaaggaggtcttcatataccctgtctgtgcttattttgtgttttcacaacacaaaatattttaacgatgatttaatttagttgtgtattgatagtctctgtcaatctctcagggttttttttttctgagggaaaaaattacattttgtaattttttaatttagaaacaacagcaataacaacttgagtcggtgacttctgaaccatttttgttctgattatcactgtaaacctaaatgtgtgaacactatcagtagggataatatttaccctatgggactgttaagcaatttaagatgagataagaaatgtcacagggaaaaggtgttactccacacatggtagtcgttattatttattgggttgaagtgttggcctcccaaagggcaatggtgatttaatagaatataagcaactaaatcccaggttaaagcagtgaattcctaattgtagaattttcctgttaaactatcaggtgggaaaggcctgtcaagatgtatatggaaggagtgagatccttgaaataattaatacacctggtataactcccatcattaggtaaacctgggctcatccctactagacagtaatagaaaattagaggataaaaggatagtcacaaaaataaatagaatatattgaaagctaactatgtactaaacagtgttctaggcatattttacatttattaattcatttaaacctctcaactccctataaagtagacattactaattatctcccttttacaaaaaaagaaatctgaacctaagagagtttaaaaaatttgcccaagaccacataatcagaaggaagattttgaatctgatttttcctcacagcaaagtccatgcattttccactttatcacaccggtttttgtttttgtttttgtattattatttttgagacagagtctcattctgtcacccaggctggagttcagtggctctcagctcactgcaacctccgcctcccaggttcaagcgattcttgtttctcaggctccagagtagctgggactacaggtgtgcacttgtattttttagtagagacagggtttccaccatgttgcccaggctggtctcgaactccttttactcaagcaatcctcctgcctcccaaagggctgggattacaggtgtgagccaccgcacccagccaatcacactgtatttaatatcacaacgaagtgcagtctgcccttctcaggatgatcttagatctatttttcagcaagtcgcattcgggtggagcaaaagcttttaaatggtggtcaattacacaatgattaaatttagtttaccattataggtcaaagggaagtgggaagagtttgatgactgtgtatttgtcatgtttctagttatagtgtacaactctgcctgtttatctgagtgagtgccaagaggtgaggtcagggcaggggctcttgcacatggcacatactatctgccccacagctattttgacttggacagtcattgtgctgggtggtaaaaattccagtgggctgggtaggacatactggggccctgtttcctctcatctgtgtttgagaactaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactaggtatgtccagtagcagatctgtggaaactattagaaaccgagctaattgtggacttcttagcatgcctcaggaaatgggaaggaacttttcccttttgggcttgtattttttccaattttccttgttcgggaaataattaattctttaagcaatgtaacctcctgctgtgatttctcaattccacaaaagagaataattatagattaataatggaccaaaatagaaaaagctaaatgtgtgtagcagataagtaggaaatgttctgtcttgtaaagggtattgtttcggtgcccggcaacacagaaacaattctcatctatgcagctctaaatggatgttagaattcacccctctttcctactggtataaaattttcagtctcagtaggactaacgctttgacacatcctaaacctcaccaggagtaggaaatatttctcatagcataaatattttttcttccttgaactgaaaggtttgtggccttccccatgcatgataactgggcagttttcagaatatacctcacagtaaaacttagacttcacacctgtaatcccagtactttgggaggccttggtgggcggatcctgaggtcaggagatcaagactatcctggccaacatggtgaaaccccatctctactaaaaatacaaaaattagctgggcgtggtggcacgtgcctgtaatcccagctacttgggaggctaaggcaggagaatcacttgaaccagggagtcagagtttgcagtgagccaagatcacaccactgcaccccagcctggcgacagaatgagactccatctcaaaataaaataaaataaaataaaataaaataaaaaacttagacttcaagttttaactattgaaaaacttccatgaattgggtacagtactgagctaaacgttgtatatatgttatttattcaggaaatattttcaggtactatgctgagtgctaaaagcattgttctgccttttaatactaacaatgcctgtgaaaaatatgtaggattatccagactttataaatttaaaacattaggattcagaaaagtaatatgcacatgctcctatactttacatgtgacagactggaatcaaatggtttaggatgccccgaataactgaactcttaatgccccagaagcccagatcgggacccaccactgggagttacagccctctggagccagcttcagaggtgcacaggtttattctcttccctattcaccagtgaaagaagcccagagcctccattccaggcactctgtgcttcccaaagtaacaattacttaatttgacaagataatttaaagagattgccaaaataacttacaggagattgccagtataatcagccctcccatatctggggattctacatttccagattcaaccagttgaagagagaaaatatttgaaaaaaaaaatttaaaataatacaaataaaaacaatacaacatagtatttatatcatattgggtattgtaagtaatgtagagaccatgtaaagtatatggaaggatgtgcataggttatatgcaaatatgctattttatgtcagggagttgagcatctgcagattttgatatggaggcaggggtcctggaaccaacatcccatggatacctgagggacaaatgtaatcaccatgttttcccaggtggatttttaacagtggccttctggagacactatgcctatggtttagtctaattgttaaaaattgggataggtgaagaaagatggcagataggcacaatgggaggcagatatttccataaatgccttttaaatcagatcctttctagattcacttttggctctggatctggaagctatcatcatggcaaccccagagtcccattggtttgcctattggttaggtgggccaaggtgtccacatatcacaaaagagttctcaaaaaatttcttcccaataacgagggagatttatatttaagagcacctttagccaaactgaaggaagggaaagttcacaaatatggtaatagctcaagtcaatgaattagaggctttgtgtagggtaattgttgagacctccccagttgactgaccaaaacaattctttgttggctagcagagttagagaatagaattttgcataatccaagtatttcatataggtcccttctgctgttactggagcactagtgagctattgtatttgtggtcataatattagctgcataggtagttctataaatgtgtctggttaataatccacaaacgtcagtgttttacatttgtaagtaaagaagtctctgtccacagcaaaaacgttaccaggcaatattttttagcattaaaaatataaaataaaatcaagttacttcaaagttctaaagaactagaagtcaataaaattcataaatatttatttttcaataattctggatgtatcttaggatcctaatataggatgtacatcctaatatagttatgtttacctgtcatttattttaattgatatatgccagtacttctatagtaagattttattggtaaaatgttttttattcttcaaaatgcagattcctttcatagggtatattcatctaccattttccattctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggaaagtgacaggcacatcttacatggcagcaggcaagagagaatgagagcaaagcaaaagggaaaacaccttataaagccatcagatctagtgagacttattcactaccacgagtattgtgtgagggaaaccacccccatgattcaactgtcttccaccaggtccctcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctccaaccaatgatttgtaaaggaatcttcagattcagatttatcctttcctacttcatcttcaattgctaaattaagcatgagtcccatcactgagataacagtctttcttggacagagttatgccaggtctttttctatgtaaagcagtcatctattaggctgtcgttggtctgtcaagatgaaactgtgtgcattggatccatgtgaatgaacatagaacattatacaaatattgtatgtttctattctttgcttgaagcttctggttacttagatcttatagtgcttcatagtataaaaaatggttaaaatacttaaaagttttaaagataaagatgtcagtgtcacagtgcataactgggttttacatggtcaagtatacacacatacacacacacacacacacacacaatttaaaaaatctctgatgcactatgccatactcagcaccaatccccattacaactctcccaatgtttcctggccaggcaggtcaccaagatgtttgggactgtttatgcctttgcacctactcatcataatattgtgtggggatcaatgggagagatatttggcccatttttaagccatatcaggggatcttccacttcctaaactcacttagacttggaatttaagtctagactattttgtttttaaccttgctaacacctacctacctacctacctattcattgtccatagcctaggtagtcttgaaaaaccctccattcccgcagcttcccccaatgcctcctctgaactcagtgtcactcctgtgtgcctcctttagtgttttttttgtttgtttgtttttgtttgtttgtttgtttttgtcattgcactcaccaccttatattgtaaaagtctattactaaggaagtattcctccctcctttatgtgcagaattccttgacagaaaggataggtcatgtttacctctgtcttgcctccaatgcgcagcatgaagcctggctctatgatcagctctaaagaaatgcttgttgatgggcaaataaactcgagaatctcacaccagagccagaccggaagtttccttcatttcatgactggttttcacaaaaacaagcattagggagagtggaaggaagagcttgcaaaataccttactactgcattatgaatgtggagttgtaattttgaggttcttatccatgaagatggtccttaaaattcagaattttaattaccaacataacaccatcctttcttactagtatcattattttatactatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaagtaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctggcaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctagggatgttgagccatttacccattgaaagatacttgggttgtttctagtttggggagattataaataaagctgctataaatactcatacacagatttttgtgtaaacatacattttcatttctctgagataaatgcctaggaatgagtgtgatttctagatctgatagtaattgcatgtttagtgtttttaagaaaccaacaaaatattttccaaaattagatgtgccattttatattcctaccagcaatgtgacagcaattgtttttctgtatcttcaccagcatttggtggtgttactttttttattttagccattatgatcagtgcatagtgatagctcattttggttttactttgcatttctttagtggctaatgatgttgaacatcttttcataggcttatttgcatctgtatatcttctttagtgaaatgcttctctgttcctgttgcctattttctaattagattgttttttgactgttgagttttaagagttctgtatatattcttgatagcagtcctttgtcggatatgtgatttacaaatattttctcccagtccatagcttgtcttttttattctctttactgtttttttccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaattagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtcttgttttctaaatcttaactgccttttgatgaaaaagaaagataaggctttaatttctctagtgaaacctgaagaagtaaaataaaataacttgtatgtcccttcacaagccacagtcagaacactgtcacaatctcgacctttgctccccaaaccctattttgcaaaccagatgctatttctttggacattacaggctattttcaaaatacatcagaacttaacaaaacatcatattagctaaatagcactataagaaactgcttataatattaaaattatgtcttgagtttataattatataaaaattgaatctaccctagagcaaaaattataattaactactaaaaaatcgaataagtgatttttttttttttttttgaggcagggtctcactctatggcccaggctggagtacagtggtgtgatcatggcttactgcagccttgatcttctgggctcaagcaatcctcatcctcccacctcaacccctccagtagctgagaccacaggtgcaccccaccacacctggtatattagtttattttcacattgctgtaaagaactacctgagcatgtgtaatttattaggaaagcaggttaaattgattcagagttcctcctggctggggaggcctcaggaaacttacaatcatggcggaagacaaacaggatgcaaaacacctcttacaaggtggcaggagagagagagagtgagaggggaactgtcacacacttttaaaccatcagatctcgagataactcactgtcatgataatagcaagggggaagtctgcccccatcattcaatcatctcccaccaggcacctcccctgacatgtggggactacaattctagatgaggtttggttgtggacacagagtcaaaccatagcacccggctaattttcttttcttttctttttggtagatatggagtgtcactatgttttgtttccctagctggtcttgaactcctgggctcaagtgatctgcccacctcggcctcccaaaatgctgggattacaggtgtgagccagtacacccagccaagaagtgatttgtataatggcaggattatgaatgattatttctgtgtctttaatttgatcatatttttaaaacagtcattatttttggtcatcatgctatatactacagagagcagtttttaatttgtgaacgtgtaagtcaacttgatttagctgaacatagcagagtcatcaatcaaactgattgatgactaagggtccgcagggtaacacatcatcatagttgtttccatggtgatgaattatgatgtcacaaactcatcaagactgtgactcagtgaaccatctagacagaggatgaaatgcagtagttcaccaacatgtatgccatctttgtattatatggtattattaattaaaacgaagggctgagtatttctttcattgagattacatgaagatattacgtatattcagacttgcctgaacacggctatgctggttttaaattgaaggttttcacaaagcaaaaaattgagaaacagaatttgacatagaattgtgtatttattagaaaagatcttttcttctcatattctgaaaagcacactcattaattacagttaaattcaggcaaatttggcaaattttcgtcagtatacttattcttttgttagttaatagctttgcttttcagttttagatattggtattaaatatataaagagaaaagaccttagtgttctcatgctcagagattaagagaatagttataggtttgaaattaggcactttccctgatagtttttgttggtacatgttttaggttatgtttctatgaacaaccagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatggtaagaccctgtctccaaaacttccaaaaattagccaccaggtgtggtggtgcatgcctgtagtcctagctactctgaaggttgaggcaaaaggaaccctcaaccccaggagtttgaggctgcagtgagctatgatcgcaccactgcactccagtctgggagacatagtgagatgctgtctttaaaataataataataattttaaaaattaaaaaatatctagacaatttctctgctttcaagactcttcaaagatctcaaagagaagctttactctggagtctcaacagaggccattcaaaaactcaacctggtttttcaacaataaattagaaatgtaatgctaacagtaggtgccaaggccgaacatcagggaaaagacattagtgaccttgagttctagactagattttaccagtttctgaccttcaactctggtactcgattttctcataaatgtgagaaaatatcttaaccgtatcacagaattgatgtgagaattcaaaataaagcatatttaaagctcctaggttagtgcttcatttatgaaggtcagtgcttcataaatgatagttatttttttccattcaaaatagagataaaaaagactttatctcactaatgtgtcatgcaaataaggattaatcctgttttctattcctgaagcatacagaatgtgatttctttctccatcatttccatctgactatcatctgggagaacacacagctgctccacatctggtgcaacacaggcagatgtagctgtccagagggagaagagtgtttgcttttctccacctaaacactgaccctcttctgcttagattcaaagactgtcttccttctgcaggtttacctgagcctggactcaaagaattaccttcattatgagctaaaggaagtcaggcccattcttcttctgcctggcccctctggctctttggcacttcccacatcctcctcatttggaaaggcttcatgactttctggttcacaaagcagctctgttgttgcttatttccactacagggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctagtaagtgttcttaattgttctgtgggctgatgtgcatttttctcctacaataggaactagcaatctacatattatttaccaagccttcctagatagaagcatttatgattattttttgtttatataaatgtcttgcatttactagaaaatcatgcttttcgagaacgcatttctattatggagtttcttaaagagagaaaaaaaatgtatggctttagaaaaatcctagtgattttttgacagtatgaactgtattgtgtgttcttgtcttggatcaatatcatggcacaatgctttgatagtgtctgaagattaagatatacaatacaatttcctcccttcccttctttcctttttccttccttcctttttcctttctttcttttccttccttccttcctttctttttctttctctctctctttctcttccctccctccctccctctctctttcctctttctttctgtctgtctgtctgtctgtctttttcttgagatagggtctcactttgtcacccaggcagaagggcagtggccctatcatatttcactgccacctcaaattcctgggctcaagggatcctcccgcctcagcctctcaagcagctgggactacaggtgtgcccctccatgtgcggttaattgtagttttttgtttggggtggttttgtttgtttgtttgtttttgtagagactttgttgcctaggctggtctcaaactcctgggctcaagcagtcctcccactgcaacctcccaaaatgctgggattataggtgtgagccaccatgtccagcccaataccattttcttatgtttcccatatatgcataattttacttgcatgcaattctgaatggatgaaacatgttttaatcacctatttttctactttgtagaagagccaaggtaacatgaactaaatcattaaagcagttgacttgttagtggattgtgataggactcaggcatttcccaaagggggaacccatattttggtaatcccagacattttaattatatttttctatccattcctcaatgccacaatgaggaacagcattctttcctgggaagtctcacaattttgtcaaaagtagaagagttgcctttgacgaatacaaatccagcaataaagaagaacaggtctaacaaatgaggccaccttggaaaatgtcattttgcccctttgagccttgcccatcttacctttagaggaagagatgggactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgatacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgttatactgtatttttaaatgtacattagttttattttttttccgaatacctttttatccatggttggttgaatccacggatgcagaacccatggatatggagagctgactgtaatagtcaaagacaagagtggctggtggtaagcacactatctgtccacaagtgaatttcccctaagaatcctgctggtacatttcttcatttcttgagattattgaaccacgtgatttgcctcactgcttatttcaccttctgggtgacatgggctgtgaatgtgcagttcaaggcctaaatattagccctgattcaaaatggacattaaccaaaaaaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggtgtttcatatggattactaattgtctaaaatttggctctaagcacctgaagatcactaggcaggagagaagagtagggtttgttgtacatgagaagaggctgtggggtggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaacggtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcattacgcttgtggatttgcatagattcagaaggggcatcttctgggaggtataagagtttatagaaagactaatttcttgactaggcacgatggctcatgcttgtaatctcagcactttgggaggccaaggtgggaagatcacttgagaccaggagtttgagaccagcctggccaatatggtgaaaccctgtctctacaaaaaatacaaaaattagctgggcgtggtggtacatgcctgtaatcccagctactcaggaagctaaggcacaataattgcttgaaccagagaagtggagattgcagtgagccaagattgtgcccctgcactccaacctgggcaacagagtgagactctgtctcaaaaacaaaaaaaaaaggaagattgatttcctgtagacagaaggagtgtttatattggcagcagcaatgcagatcaaaactttggggtcaccctcttgaatatcttatttgtatttcttcttgggttactaaagtcttgaggagaaaaatgaataaaaggcttaagaggattctcatttccatgcaaagcttctccacactcctgagagaagtttagggtcaggaaggaaggtcagacaatataaacctcagcactattcagtaaaatagccatggggaaaaatatggtaagtttgtcttaattcatacccaaggacatttagcgctcagaaaactaaaatactttttatttatttatttatttatttatttattttgagacagagtcttgcactattgtgcgggctggagtgcagtggcgcagtctcagctcactgcaacctccacttgaacctccaggttcaagtgattctccttgcctcagcctcccacgtagctgggattacaggcgcccaccaccacacccggctaattttttttttgtatttttagtagagacggggtttcactatgttggccaggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcactgtgggaaacatttacatcatatgtatttgcatacagaggaaattgataatcttgagacatcagcatactagaatagcaagagacatgttttattctattatattctcttagtcagcaatgtttaattgttgcttaaaggaaactgaataaaacgtgggcgcagtggctcccacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtcaaggctgcaccctggcctgggcaacaaagccaaaccctgtgtcaaaaaaaaaaaaaaaatacgtaaagcaacagtttttctataacggattgcatggtaaaaggaaggatgactttcttactataactccttatgataattttttccaaagtgttaatcttaggggttgaaatttttataggtaatcattaactttagtagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgtgtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacgttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaaccaagctcacccacatcctacgtcaattagctatttttttttctgtgtaaacaatgggagggaggtggattgtagcttttatggtagaggttcctcggcacctcctgacgcccccaggggtcccccctgccactgccctcagcccaaatataagctgacaacaaaatgtttcttcaaagtgctcattgtttactctattctggcttcttcttaaaggtcatcatcatgttgaattatcttgagaaaatcctctgaagtgtatgtgtgtgtgtgtgtttaggaaggatgtgaggaggattgggaggtgagtctctgaataacaagttgaaaaaagagtatggaggaaagcggtgtttaaaattgtccaaagccatcggccgggcatgatggctcacgcctctaatcccaacgatttgagaggctgaggtgggaaaattgcttgagcccaggagtttgagaccagtctgggcaacatggtgaaaccccatctctacaaaaaaagtacaacaattagctgggcatggtggtgcatgcctgcagtcccagatactcaggaggctgagatgggaggatcacttgagcctaggagtttagggctgcaatgagatgtgagtgcaccaccatactctagcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgttgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaaacatgaaagcagagtggaaatatactgtggcaatacatatttggatatactggtattaaaaagtaaggatgtttcagctaaatcttttttggtgtttattttttaaaaattcatctattaacttcctacacaccatgcatatattcagctaaatcttaaagtatgagaagaaacatgccattcatgaaagggaagagggagccagtgcatcagatacaacctatgcaatcgtgaagatttatggcagagcacaggatatttggggattggcaggcatttcaaaatggctggcacataaagttccgggatgggaacaggctggcaagagaagagatcatcggagccaaagtaactgaactgtgattgaattttagatatgataatatctataggaaacctggcaacccggtgggcaggtaaatatgatagagcgaagatagaatcttcaggccttcaggggactaagcaggaatagaataattttattgagcactttaagtggacattatgctagattattttacatatttcatctcctttaatttacaccacaaccctgtgagtgcaggttgataaagaattaaataaaatccaggtgaagtagcagcacctatagttccagctacttgggaggctgaggtgagaccattacttgaggccaagagttccaggctgtagttcacaatggttgtgtctgtgaatagccactgcactcctgcctgggtgacacagtgagacctcatttctaaaaaagaaaaaaaaaattgagacagggtctcgctctgccacccaggctggagtacagtcacgcaattacagcttactgcagccttaacccccaggctcaaacaatcctcccacctcagcctcccaaatagcttggactacaggtacatgtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcatagaagagtctcttaaacctttgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttttaacacaaatggaggactgaaaaacaaaacaaaacaaaacaaacaggaaggaattgcagatatacagatctttggcctttcaaactatggtatctcttagtactattttatatattgataataattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtcaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttatcactgtcatgttctagccagtctttattatccccgccacacaaatttcatgttcttctggcagtcaaatcaggaaattcaaggacacaactgctctggcttcgtaaagatggggatcaaattgtttgagttgctgatagcaactctttgcttcttgattctccatgcctcctcaagcttttttggctgaacttttagccttggaacagggtcactggaaaatacttcttaatatccttaatttctaattctaatatttgccttgtttcattttgtttatttggggaggatgaagttcaggtgttcacctatcaaactcacttccttcttttttttagacaaggtcttgctctgtcgcccaggctagagtgcagtggtatgatgttggctcactgcagcctccacctcccaggttcaagtgattctcccacctcagcctcccaagtagcagggatcacaggctcgtgctaccacgccccactacttttttgtattttttggtagagacggagtttcatcatgttggccaggctgatcttgaactcctgacctcaagtgatctgcctgcctcgacctcccaaagtgctgggattgcaggtgtgagccaccgtgcccagccctaacttccttctgatcaagtcattctcaaaaataaacatttaattgactgtcaactacaatgataataagacaatgtttgccttaaatgagctctaaatctagttgaagggataacacatggaatggactggtaataaaaagtgggctttgcttggtgctacagttgtgatgtgaactaaagagggagtgttttggactgactttgagttggggaggctttatggaggaggtgacatttgagttgggccttacgttgtattttatgaaataaaaaaagaggaaagacagtccaagatgagaagacagtataaataaagggacagaggcatggaagggaatttcttggccaaaggatagtaaaaagtacagaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaatagacatcattcccatagcaatcttttcttgagacaaagaggtcagtaggccaggttctgcatagaatataagctatttttccattttagaatgccactctccattgatgtctactctcgttaagtagaaaattccaagaagtactaacaaaattatgttaatttgtgtatgtactgacttccagacatttggaaccagattctgaacctgtaactcatttaaatcttgccgtgactttggtttcccaagttctaggtctttctctgaaaatttaaaatgcttctggaaagatattttccatgacacttttgccttaggaaaaaaatttttggtcaacattggaagaaaaaaaaactgagacaacatatatcttgctccttaacatattctgtatgaaattaaggtcttattgacaatctacgtatcagagcctcgtacacaggagctattgaaatgatgtgtcagttcagaaaatcatgttcattatttctgattctcatcataaacaagcagtaaatcaccgtataaggggtgtatgcattagggcctcccacataaacttcacctctgcgtgtgtaaacattttcttattatcgcaaataatcaacaggagaagagcaaatgcaagtttagcttttctccagaatgtttatcatggttactttaaactgtttataggaaagagtgaactataaatgtctttcaggaggtgggtaggaccatatggctcagaggcttttctgcagtaaaatgtttggttaaattttaggcaacagacagtccttccacagcaattatttgtgatttcgagcatcgttgttgatactcaactcctgaaacaaataacaccgacctaaaacatttataataactgaagaaaccaggttccttttaaccctgctaggatccagctgcccccttgcaacccatccccagtcagctgcagctcaggcaagcccagcctttccatccctgcacatcagactgtggtgcagagaaactccctgtgttcttcaaaacaaacattggatgtaatccacctcaatcttttccatggtgaggctttacaaattttagttttctctaagaagatagcctgtatattcaattgcctgggtaaaagtttaatttctgatgcgtaaagcatatcctgccttgaaaaatatctcaggaaaaataaaggccacaacagtttcatgtgtgcctatatcaggattgctgctgagtaagttgtgaaatgtttttggatttctgagccatttggatttcagaattgtggaggaattctggatctgtattttattgtgtattaccaattattttcctttctcttttatgtgacgggtagtattttgattatttaaaatcatctttgtagaaaaattattggcagctatgaatttcatttcaagatatttaagatgccttagaaacttttctaaaaacagtataataggattgagaaccactcatgtatggcctttactgtttcgaggtttttcttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctcttttttttttttttttttttttttttggtggctgctctcaaatttttgggctcaaatgaacctcctaccttggcctcccaacgtgctgagattacaggcatgagccaccgtgcctggccagctaaggttaatttagtattgaagaaatatttttgttatgaatttagtgtagccaagtgtgcagtgtttagaccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgtattacggttctctagtgctcagtacagtgacttgctgtacaggtttgtagcctaggaacgataggttataccatatagccaaggtgtgtagtaagctgtaccatcttggttcgtgtaaggacattcagtgatgaaattgcctactgacacatttctcagaaggtacccccatcgttaagcaaccattactgtattagaaagcagaaaaacaaattcagctccggacttagcctacccatatagcatcattggccagaagaaaatcactttgctttatgaatcccagttttctgcgggaatgaaatgaggtaccatacgtgatcctaccagcataacacctgccaaatagtgcacattcaatactaaaccatcctttttatgcctataaataaaggatttgtactatatcaagagcttctctatgtctgaagttacaatagagtaattccaaattatctttcatggaatcaaatccctgatgatcccttgattttctgagttctgtgaatttcatcacagcccaatttgacccattactgctaattcagtgtttttattagtaaattatatttccaagttgaatcaaaacaacagtatagcaggcacagcttaagacacaagataaataagttgttgcattcaccagtcaaaatatttttaaaaaatcaagaagcaatcactgaatagttttccttgatttagataccaattaggtttaatgaccaaatgagactgataatcagagctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgagtagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttagaggaaaaactgttcaaacaaccttttattcatagacccatgttatttaattttagaattatttcccatgtatgcacaaccgaattttcattttcataacaagaaaacaaattctttaagtgagaaacagtacattttacacccttccttttcacaaaaatctcacagtattttctgacttatggtcttgataattagcactcctgtttgctcgtgttctctttctttcacaagcaatgtgatcttatttttaaaaaggacctgagacaagtagacaattgacccttgaacaacacagatttgaaaagttttggtccacctatacacggattttctcccacctctgccacccatgagagagcaagaccaagccctcctccataccctactccatctgaagatgaccagggtaaagacctttatggggattcacttccacttaattattagtaaatatcttttctcttccttatgattttctcaataagtttcctttatctagcttactttactgtaagaatacggtatagactacatataacacacaaactatgcattatcaactatttatgctgctggtaaggcttctagtcaacagtaggttattaatagctaaattctgggggagtcaaaaggtatatgcagattttcacgggtggttggacccccccagcatccatgttgttcaagggtcaactgtatatcctaattgttatttgacactggaagaaattagatctcctggccgggcgtagactcacgtctatcatcccagcactttgggaggccgaggagggtggatcacctgagatcatgagttcgagaccagcctggccaacatggtgaaaccccaactctactaaaaatacaaaaattagctgggcgtggtggtgggtgcctgtagtcccagctactcaagaggttgaggcaggagaatcacttgaaccctggaggcagagattgcagtgagatgagattgtgccattgcactccagcctaagtgacggagtgagactttctcaaaaaaataaataaataaataaataaattatatctcctcttagaagtttgtccctctcttcaactgaaatctatcacagttcgacctacatggtagttgcattgatctgtccatcctggtgccacatatagaacatctactttgtcagatactgttccacatacagtaagcagaacacatgatcccagtccacatgaaggatggtgtccagtcatgtatggcctgattcttttctgtaaagtgctttcacatttgtagttggttcctttcctagagcactcctgtttttgcattcttgtagaaagcaaattatttccaccctgtcactgatttttttctccaattcaaacaatacgaactagaaaagagaactcccttgtaatataaaaggaaatagaaatccctatgtattcaatgtttttaaagtttaatatgattcctcttagcaataaccagcaaaaagaaaatgtttctactttaatcttttcttttgaactgaagtgttcctctatgtcatttacatgacaattggcccaaatctctctgttaccaggacttggtattcaaagtaagaggcttcattaaatttcaagaggacttttttggggaaagtttttgtttgttttgttgtgttttatcataacaaaacaaggcatagtgaccaggaagatggagtttctagttagtgcatacatatacatgcttatggttacttaatgtgatagaagcaaattattcagatgcctcttctccacagaaggttttggtcttcagcacgtaaagcaacttttttttttttgtttttttgagatagagtctcactctgtcaccaggctggagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctcggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatgttctggccatttttctctggccttatgtagctttagcttttcattctcaaagcatggatcaaagagctataagaagaaattaaccagagactttatcctgattgtttcacatttccaaaggcaataaatcagtcatgggctgagagaagagaactgaagtctaccacaacaaatatatttctgccattttttcttttatttcctataggttttgctttatgaattttgacatgatattttcatcatgtgtagatatcatacctctttatgcttttattgcaggtgaagtcatttcctaacatcactgctccctctcccttctcccagcagttatctatgtgaaacaaataaatgttatttgtgaggttcagctaattcagataattagcattaccaagaggcttacaattattctggaatttgtgtttgcttatttgtttccccaaatacagctaaaggagaggagaggatcaccagatcttatagtaggcaaaactatgaattattagtaaatcttcctcctggctttctatctcactggctgctcattctcattgtccttcactctttctcctctgtttaacttccaaatgccaagcatccctgggagtattctcttcatttattacattcactcaaatggttttaaataccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctacccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttttattttacgtttgccttttctaacaaattctccttaaaacagccagaatgatctctttgatgtatgatttagccaagtgtggtggctcccactagtaatcccagctactccaggaggctgaggtgggaggattgctgggagttcaagaccagtctgggcaacatagtgagaccccatttctaattaaaaaaaaaaaaaaagaagaaggaaacatgaattagattttgttgctcccttgtttaaactctctattggctttttacttcatttagaataaaatgaaactccctgtcctggcccctatttgatcttatttcctgtcactttcccattgtctgttatacctcacaatcactggactgcagttattgctgttcctccgaactacaggccttagggcctttgcaattgctattttctatggctggaacactttctcctcagatctgcaaaagattggtatcttgtttagtcagatctcaaattaaataccacactctcatagaggccttctctcacctcaggctggtgttggtagcagtcattgaacttcacaacaccttatgttaatgttgtgcagaacacttaccactgcctgatattttactgataggtcttttgtctgtttcctgccactcctgcccctgaaatagaaagcaagctccatcagagaagaactttatctgtttgttcacggcagtaattccaggccttggaagagggtttggcacacagatgttacttaataaacataagagtgaatgaatgaaaattgttagaagacaccatctaaagtgagtcagacaatatgtccagcttcttgtgtgtgctaattaatgacactttgtggactatatatctgtatataactacttcatttcttacagagccttgatagatgaaagtaactagacatttaacttaaaaggtgctaggtcatcttcagttccaggctgtaagcattaagattgactgtacacgacctgttaaaaccattttctgggaaaggctcttaagtacctgtcagagtttacaatttgagagcaaacataaataaacccaaacgcctttcaactttgaacatttgatgcttgaaaatcacctctatttaaatttttgctagtcacatcttctcatcttttggtttcaggacctgattcatcagtttctatagatccatttataaactcagtcagcattttactttgccagcctatgagcacaagtaggcaactggaggcttggaaaaaacccagacaacaacaatttgtttttcactggttctgctttcaaacaacttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactgtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaattctggctcctactcttccaatgggctcagcttgtctcatgatttaatagtactaaaaaccttttcttaaaaagaaaaaaaatcctttttaaaaaagtttaggtataaataagaaatttctatattatgaaagactggtttgcaaagaaactttaatatcttctggatctcatctcaatcacagtctatgaaggaaataaaataagtgccttctaaaacggcctattatactactatagctgttgtctataaggaaaaagtttgttagtgagttgtattcaatagaaaacctcaaagatggctgggcgcggtggctcatgcctgtaatcccagcactttgggaggccgaggtgagtggatcacttgaagccaggagttcgagaccagctttgccaacatggagaaaccccatctctactaaaaatacaaaattagctgggtgtggtggcgggcgcctgtaatcccagctatttgggaggtgggagaattgcttgaacctaggaggcggaggttgaaatgactctagatcatgccgttgcactccagcctgggcgacaaaagcgagactctgtctccaaaaaaaagaaaagaaatcctcagagaagatatcctagaactatttagttttcccttaatcgagtctgaaaacctcctgtgcccttccaccacttaataatctaaccaactattgtaaaattacctattcttctaaaccaccaaatagttcgaatagaatagccttagatatctaataactaaatgaaaccacagtttacctctctaggcttcagtttcttcttcataaaataagaagcttgaactcgaaaagttttagatgcgaagttcccaaaaatctagtagaggaagcaaaactctgtttggcaccctgtttccttgccctggacttttagcatttctttcttctggtgtaaagtcaaacaaaaaatagagatgaatctctaaatttacctttttattggggagataagagttgcaatacagggcatacacacagacctgatagtcttctgtatgtcagaagaacaaagagaaggttggaggttttacgaaaaggagaaatgtcttgtcctgaaagaaatttcactggcactagtaaagttgtggggagtggcaacctctgattggtgagtgacaacagtgcagtaggtaaaactaatcttagactcacagtggttgtcttagctgctattagataaaagtgatttcaggttacagcaggcagtttcagcagctaggtttgcagagaattacattcctagaacatgatattttaatatacatatccattgtgaaataaatactataggcaagcaatttaacatatttatcactttccatagttaacatttttgtaagagcacataaaatctacttattctgcagattttgaatatacaatacaatattatttactataatctttctgttgtacattagatctctagacacactgattctttttttttttttttttttttttttgagacggagtttcagtcttgtcactcaggctggagttcagtggcgcaatctcggctcactgcaacttctgcctcctgggttcagatgattctcctgcctcagcctgccgagtagctgggattacaggcatgcaccaccatgcccggctaacttttatattttgggtagagacagggtttcaccatgttggccaggctggtctcaaactcctggcctcaggtgatccgcctgccttggcctcccaaagttctgggattacaggagtgagccaccatgcctggcctagacatacagattctacatgattacaagtttgttccctctcatctactttccattttctcctctccctgcccctggtaaccaccattctactctctgtttctatgtatttgatttttttttttttttaagattctacatgtaagtaagatcgtgcagtagttttgtttctatgtctggcttatagttcacttagcaggttcattcatgttgttgcaaatgctagaatctcctttttaggttggataattattccattgtgtatctataccacaatttatttaccgcttcatctgttaatggattcttaggttgttttcatatcttggctattgtgaataatgctgcaatgaacgtcaaagtgcagatatgtccatgaggtgtttatttcatctcttttgggcatacccagaagagggattgctggatcatatggtagcagaatgttttatttggaagggaaacttttatactgttttccataatggctataacaatttgcattccctctgaaagtggacaagggttccctttattctacactctcaccaacacttgttatctcttgacttttttatacgagtcagtgtaactttaaatccacctggcctgatgctaaattatgaatgggaaaaattatattaatacttagaatcctgactgggtgcagtggcttatgcctggaaccatagcactttgggaggctgagatgggaggatcacttgagccaggagttcgagaccagccagggcaacatagtgagacctcatctctctaaaaaataaaatattagcctagtttggtggcacatgcctgtagtcccagctactcaggaggctgaggtgtaaggatcacttgagcccaggaggtcaaggctacggtaagccatgattgcactactgtactctagcctgggtaacaaagcaaagcaagaccatcttcacacacacacacgaaaaaaacttagaattctttttttttttttttttttttttttttttttttttttttgggggagggtctcattctgttgccaggctggagtgcagtggcgatcttggctcactgcaacctctgactcccaggttcaagtgattctcctgcctcagcctcccgagtagctgggattacaggtgcctgccaccatgaccagctaattttttttgtatttttagtagagacggagtttcaccgtgttggccaggatggtctcgatctcctgacctcgtgatcctcccgcctcagtcccccagagtgctgggattacaggcgtgagccatcacgcctggctaaacttagaattctttacattcaaataatgtctggtatttttttacattattttcatgtatattccctaatttaaacttatccccacccccccccaccccaccatgatgtcgtcaacacagaactgttttctagattaggaaactgaggatagggattttaagtatctcgctcctagatcaggaccgcatccaggttgcagaatcccaatccagcactcttccacatagtcacagcactaccccaactctaatctactgatgacacagaacaaaattaaagtccttgtccaaatcccagagttcatgaacacagagatgttaatgctcctgtagttcatactgcaaaaagaatgtgagagcttgtttcatttttcacttagaaaatgtatgagatgttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatggtgaaaacccgtctctactaaaaatacaaaaattagctgggtttggtggtgtgtgcctgtagtcccagctacccaggaggctgaagcaagagaatcgcttgaatctgggaggcggaggttgcagtctttagcatgggtgacagagtgagattctgtcttagaaacaacaacaacaacaacaaaaaccaacaacaagcacaaaccaataatagaaactttaaatgattctgagccttgagaggaatgtgattatgcaacctgggaaattcacctgcccatgaatagtatctctgtaattaataacaaagtcttacaggacagtccttgccatcaccatatcataaacgtatattgcttcttttagttcataggaacagggtctcctgctgtgtcatagctgtaggatttagcctaaatgctcagtgagtttgatgctcccttgagcaagcccgcttatttaagaaagtagtttttggatattcatggtttattgctgacagttaacgttctcaaaatagtgagagtcctaaagtcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaagtattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaatacaaataaacaaatacaagaaggatctatcacaacaatgctacagtgatgagccttcagataattttcattatttttcttgatacttctatatgttcaaaactttcattaatgagcctgtaataccagcactttgggaggccgagatgggctgatcgcttgagctcagtagttcaagaccaagctaggcaacatggcgagactccatctttacaaataatacatacatacataagtaactaagtaagtaaattagccaggcatagtggtatgttcctgtacttccagctacttggagggctaaggcaggaggattgcttgagcccaggaggtcaaggctgcagtgagccatgtttatacccctgcaatccagcttgagtgacagagtgagaccctatttcaaaaaacaaaatttcactgatgacaataaatattaccttgacatcaaaaaaaaaaaaaaaatccagtgcctggatgatcacccagtagcatctaaaagtgcatttgaatatatatccaggttctgatgccagcattgatgcttgttatgtgacaaaaagaaatcacctaactgctttgggcttccatttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatttgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatattattgtggcagtaataatattatcattcacatgtgatcaatagtaaaagcacacacagcaacccctcaggatttcatcctcaggccattgactcccatcacctttactgatatttagcttagctttacaatcctcccctttgaaaaattcatattttaaccttgcctcccataaagacacacattttttcagatatagaatttgcaaggctgagacatatctttttagaatgaacccaatataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccggagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagcttaattcatagaaatcacttattcattcaaaaagcattcactgagttcctagtaggggccacatattacgctaaagtagatacaaggataaaccaaatgtagatctgtcctttaaagagtataacatgtagggaacaactacactctacatggcaatagaaagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgcacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacttgtcaggagcatgacagttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaagggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattgtcagaagtgacaaaactgtacatagacctgttcacataactaacaagggaaacgatggaggtgatgtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatggaaacagaagtcaagaagacagtgaagtggatgaagcaaggagaaatcataaaaacaagcacactgggactgtcggacctcaggggagagtgacgtggatggtaaaccaagtttggggccagagaaaagtgaaagcttgtgctgttcttgttggtagtcatgggcaggctgtagcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttataaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttttgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctgggactacaggcgcccgccaccacacccggctaatttatttatttttttctttttttcttttttgtatttttaatagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctcccattcaagagcatataaaactagaattactttgggatgagtgtgagtgggggagagagaaggttgggagatcactagttgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatggctcactgcagcctcaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcaggctgtttaatagaagttatcaacatatggagtcatttatgtctattgaaatatgaacagccaattcccttcacttgtcccatttctaattcagacactaattctgtttcagtttaacttggatcaatggacttatctttgcttctgttcagttatctgtttcaacaacaataagattctttatctatatggcatagtgggtgaaaggacacactaaccttacctactgctccttttatgtcagaaaatccattttctaatcactttttcttggacccaagtgagtctgttttttcccctacattttgtaatttgtcacatttacattttaggtgggttgttctaatcgacttttcttataaaagggtagtggttctagatcaatcgccatcaatcatgctaccaagcaatggtgaagtaccctttttaaaatattttatttagaagaatttcttatttcagatacaacagatgatacaagttgaatctagtagggtttagtaagagacaataaacatattaaacaaagccttacgtattttttaaggtgaaaaaaatcccccaagatagagtccgtgcttagaaactacccctgttaaatacttaatatataacatttgtaatgttcaaataccgaaagaaaaaaatgtacttgttcagagtctattcttgagtcaacctaccttctcagctctactgaccccaaacaaggtaaacaagctgatttaagttacaactaacttaaaaattatacatctaactcttttgtaaataactttagggctggtgctcaaaataattggaactagctatgaaaagaaagctagaaatgagaatgaggaaaattggtagtaagtgtctatagagaagtgtggaccatctgcaattcctatatttaaacagggagaagagggagatggggactcactctctccctcacaaccacatgactaaactggcccagccaatatctcatcaggtgtctccaccactttacaaagccactgggaatttatcaagggataaatacaaaactggtgtagggagaggggaatgggaagttacttccaaagactctgaccctgagttcttggcgtttattcttttttttgagacagtctcactctgtcgcccaggctagagtgcagtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctctcaaagtgctgggattacaggtgtgagccaccgtgcccggcccttggcctttattctttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgcgggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaagacacaagtttatgaatgacaaatgggtaggggaatttaggctgcacagttaagtaggaagaatgaagtctttgctagagttagaatccagtttgaccttgaacaagttactcaatgactaagctccatttgcaaaatcgttttgttaaagggattagaggtaacatatctacatatgtacatgtgtacagtggtatggagaatggactggatgaatgcgtgctgttaccaatgtgataattactattctttttaaaaatagagtattttatgcatacacaatacttattcaattcaatttgccttagtgcacagtgatggaattttagaactggaattgacttcagaaataatctggtaaacgaaatcttttcgaggctcttcattttatggttgaggaaactaacatcctgagagctaaaagtcatcgttttcctttaaaatatctaaataatcccagatgttggatcagaactccaaagtcataatcagggcttttcctatttctatagtatttctaatactataacatgctattgctcagtcttttattctctaattccatcctggtttctagaccaaatatacctaattgtattctaacccacaagtacctcatcaatgagaagtctgacctatggtttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggactacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttatagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactctactggtatggcctcatttgtcgatttgaggattattggtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagcttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccagctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctcacctaccaagtagctgagactacaggcaaatgccaccatgcctagcctgtgcctgttttcttaaggcagaaatgatctaaaagtgtggcagagggaaaagaagatgggacttagagcttaaataaatctagatgaaaatgttggttctatcactcacaggttctgtgatgttagggaagttaagttatttgcaataaaaattattaatattgtagaacatgtattgatcctatgtatcaggcttgaattaggtgctttaagtgggttgtctcaattaattcatcactctgattttcaattttctgttctaagaaatgagatcaaatatgcctatcttgccgaagagtagtaaaaattagacaggtagctgcctctggatcctgcagggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaaagaattccagagctggctctaagagatagagcagctggtcatatatgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactctttttggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctcttgacctctacaagagccagcaagattgatggtttcagcagcctttcatggtgcactaaagcattcagatctatcttttgttatttgggaaacactaagttcttatgtagcacattatttacatggactcaagggctgacgagctgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcagcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaatgtgacaattcagaatgattgggccttttcctccaaaacgtttttctcctcaaaagtaaaacaggcttgaaactcatgtcttatatatgctgtttagattttcatatattaatgtcacgaatcagatgataggaaggtatattaacaagtgagacattgggatatggccccttgttcaagagcatcaaagcattaaatatgttgttttaaaaatacctttggcatagttttaccacctatttctcaattgccatcaaaattttaacttttaatgacttttggaagtaggttagatggggtggtgggagaggaatagaggatacagaaagataaaaactaaatccaaaaatagtattgaatgagaattactaataagaattattaattgagtgtcttctcataaaaatagtaatatctgttctttggtctctcacaatacatagtttaactccatatataatttaatgaatgcaatgtgtcactttggttataggtttgcatcttggaaacgatgttagtagaaacaagtcagtttccctctgttcctttttgcttagctttctgggctatcttcaccaatgccacagtccatctgtaacagaatgcattggagatttgaaaaatcacgacagataataaatctctatatacttctcatcctctggaacaattgagacattgaaattgcctgatctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtgggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgttttacgtattatttatttatttgatactgttaataaaaagcaaacaagccaaaaagaaatactccccaacgtttaatagagatcattgtatcctaaaatcttatagcacattagagtgcaatgaagctcaatgtaacaagcatcaacaatcaactacgaaatgagtatggaaatagagtatatccaaggaagacagaagtgtagaccacatgatgacagcgggataaagacaaaggagaaggtaatcgagagccaagggttaaaccattcaaattgtcctttggcattaaaatgatccaagatgtttcatgagttcaggttaaaaaaggaaatcagtaaaccccaatatactttaagtttcatttgacgcccacaagctgaaactacctctttgtggtgtgtgtctttacatcagcaaagagtataattgaatttggttattatctccagtgctacctgtttggacctgctatttcaccttcctgaaaactgttgcattgagttctactggggaaaattcttaagataacatctgtttactaagaagggggtgtgcttacctgctctaaggtattgaaatacattgtaaatctatacctaattcatataaacataatttcaaggaaaaacaaaaacataagagacagaccctggcggagtgccaaagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcaagcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcatagttcaaagaaaaggagagagtagagtaaaggggcttagtgcaaatgtctggtcagatactcaaaggtttagagcctcttaacccttatatttctttacataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagggatagggtttcaccaggttggccaggatggtctcaatctcctgaccttgtgatgtacccaccttggcctcccaaagcgctgggattacaggtgtgagccaccacgcccagcccattcttgtttcttggtaaaggaaaatccaactatatatatcttctttaggatcacttaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcagaagcaatttgtaatgatctcacctatatgtggaatctaaaaaaaagtcagcctcatggaaacagtagaaaggtgattaccaggtctgggggctaggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagatgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccaatcatggcagaaggcaaagggggagcccacatatcagatggtgagagggagcaagagttgagggggaggtgccacgctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaatctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaataaaggttgtgttagaacaaaaaagaaaaagagtgacaatgcaagccacatagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctaatggttgcattatcttgggcaagtcatttaacatctctgccttaattgattcacctctaatatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgaatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacgctgtatgagtaacagaagatgactgggaacagaaccgtgaacagaattaagcacctgcaatcaaataaaattcacagaaaacttaatttaccacattagtgatatgcataatcgttgttgtgctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggggttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgaatcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggctttgatctctggggacagggcgttagacagcatgaggcttaggttgccaggtgtcttcccacagttcctgtcttgtgtatgttacacactcaattcatgtcaggatgacactacattggcatgatccaagggaacccataactgacatgaatatgtgtgtgtgtgttgattggggagatgggaaagagaacatttcttccagattttctagttcttatagttcataatcttaatcctcatctccacttctctgccacttctctggctaaatccaaagcacagcctggctagagaggacttctcttccttgggggttctagtctattctctgagttgtgacaaacatttccattccctgtaattacccacttgccttgtctctgaagaggcattcacagaataaaccaaaagaattgtagtgttaggaagatgtcaaatcatttgacctctactccatctccggcttttccttctccccccatgaaagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaagtcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccaggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtgggcagaaaaagaaatagacaatgacaagatacattttgaattagtgtgatttaaggactggctgatgtgcacaaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagtcatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtattaccactgggttttatgttttaatggaaacatttcatgtttagagaataatgatgcttaaaatttatatgaattaaaattttagcctgtaaaaagagcctggaaatatcttcataccatcatctatccttccacttaaatattaatcacaaagaagatcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggcgcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgggattactggcgtgagccacacacccggtctgctctccctcctttcttcacttttctgcttcctctctcatattaataataagcttctatctttccttaattgtttacatatctgtctgtcctctttctccaccccacgaactcctcaaaggcagagtccctgtcttttttatttcatatccctaatggtagctgcaaagcagacactcaagaaggaaggaaggaagtaggtgggagaaaggaagaagaaaggaaaatgaaattaactactagtttgtttccctgtttcattgagaacacacgtattaaccaaacaagtaaacaattgtcagaatattgcattttaaactcctgagagaagttgctgcttctgtggcatttctatctaattaagtttccccttaaagttgtaatcttttctttcaaatctcataatacgtcttatttaggtgatcataccaattatatctttcccactcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctcccaagtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacacaaaacagtagtgggagttcttattcagatagctaacaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcatgaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaagtgctgggactacatgtgtgagccactgtgcccaacccagaattgctggaacttaatgccaactctcaattgtctttccttctgctagatctagttaatagcaggtgtctgatacatgttactgaagtgaatatgaaaaatccagagtaagcaaataaatcatatttttttaattaaaaacatataaagtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgtctcaaatgtgcccatgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagaccgcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttcaaccggagtcagaactaagaatgctcagcagatggttgtggagtgaggtaaatttacatgcagccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgtgccttgattttttgttttgtttggttttaatctcagaccttgtttctagtaggactgatggagtcttccattatttcgcctaaatattttatgaagaacagagtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaataaaatgtgggagcaaatgaagccattgaaaagagaggccattatacttctgaccacttgggaaataccccccaaaatagctgaaaggtcccaagaggctgggcacagtggctcacatctgtaatcctagcactttgagaggccaaggcaggcagatcacttgagcccaggagtcagagaccagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcagatggcacagaaatctgtagcatctagatcagagtgacacctcagagtttcgagtaacgacaggcacctggcccatggctgggattgttaccagtggtgaatctgtgcaggtctgcagcaacctcaattcttccctctttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcgcagtgtgtttactggcgttgtacacatgctcacctgaggcgttcttcgggtgaatgcccccagaaagtcatgtaccagttaaactctgccatttggcctcttagtgcatatgtgtgagccccctgcccaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagcatttcacttaacaatagctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaattgtatgtccctgtggggaatggttctcaaagtgtagtatctggagcagcagtatcagcttcacctgggaacttgttaaaaacataaattcttgcagctggatgtggtggcacatgcctataatcccaatgggagaccaaggtaggaggatatcttgagcttaggagtttgagactagcctgagcaacatagtgagaccccatctctataaaaaataaacaaaattagctggacacagtggtgtatgcctgtagttctagctacaggggagtctgaggtaggaggattgcttgaacccaggagttcaaggctgcagtgaactgatatcgcgccactgcactccagtctgagtgacagaacgagactctgtctcaaaaaaaaaaaaactgggggccacacaacagacatactgaatcagaagcctgggggtgtagctcagcttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattggtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacattttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcgtaaataaccaatttacaagaaaatgagtctcattatattatagcacgaagaggatatattcaaggagatacacctttgaatctattatttcaatatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaaccctatgttattggatacgtaccaggtactagagattctctccctgggtagtctggcttagaatggctccccaggctctagccatctgcatagctgctagaggaaaaagctgttttagttggctccaagaatgtctctgggaattataatgtattcatagaaatgagtgtggagtgcccacttgcacaatggaagatccacaataatacacctggatctgatagcaccttcctgaacttgggccacttccctctttgaggtttgtgaggccaaagggatatacacagaggctgcctttgtttgtgattacctgggaattagatggggtatcattcccccttatatccttttactatagcttgttcacttttgaaaaggtggaaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaaacatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccaaagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttccattgattggaaacctttagtattctttgtactctcacagtcctagtttctcagaactgtctgtcccagtctaggcagttgtttcattaaacaaatgttattaaacaaataattttgagtgtgtgtctggtggggaggggaggctggggggttaaattcatgtatttttaggcaagagtattaacaagaattgtttgaaatatttctgaaaccatagtgtcataatgaaaataaaaataaggtggagactggattgtaattaacacagagcttttccatccaagacagagcttaaaggcctctgtttgttgggtcactttaaaaacaaaccctactgccagggatttccaatggcaactttaccgtgcttacccaaatggaggtaattaacaacccttctgtgtgttaaattaggtatccacagaattgggaagcttcagatatttattgtaaaccagagcctcttttcttgttaatctcctaagacagcagactagtgactcgcacccattagaacaaatgaactaagaaactgaatgacaggttctgaggcccctaagaagaaaaaacagagtctggattagagctgcttaacagaccactcactggggcatgctccctccccacgcccatttcctatcccagaaaataacaaacttcagatgacccgccaaaaacgactaccttttatatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattgtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatttgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcacttggtaatagtttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacatgtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattgtctccaaataaaagccaaagtgatccatttgttaattttttttaatcctacccagctgaaatggacaaagaggagcccatctcactcgggggaggggatcaaagagttatcctttctcttgatcaattctgtagcaatcagccatgataagaagcccaaattaccaaattaacaaaaagaattttatttagtggccatatataaaagctaaatggacagttggagacagacaacaaaaactaatataaaactaaaaatgtgaaaattcagcatttaatgaaaatgagagcttagaaaaactagcatccagatttattcagactgaatttctgccctgggaaattaatgaatcatccttcagttcccttttgtgtctgtgcatccagcctcattgtccttggtagtaaattatgtacaccccctgtttccaaatcttcaaatacggtatgcgtcataaagtcacaaaatgtgtaatttgggtcctgtatacaaattctagccagggaatggcttgtagtcatgctaaatattctttacaagttgtgtaacaaagacaaagaaaactacaaaaaaatacagagaaacataaaaaatttcccattccttctgtgattctgatgtatttccctttgattctttgcttctacattgaaatagacttagtgggtaatactaataattacagttaacagtgaccaggtgatatggtttgactaggtccccacccaaaatctcatcttgaactgtagctcccataattcgcacgtcatgggagggatcccgtcggaggtaattgaatcatgggggaaggtctttcctgtactgttcttgtgatagtcaataagtctcacgagatctggtggttttataaaggggagttcccctgcacatgctgtcttgcctgccaccatgtaagacgtgactttgttcctcttttgccttccaccatgattgtgaggcttccccagccatgtggaactgtgagtccattaaacctctttctttataaattactcagtcttgggtatgtctttgttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccacgttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagcacagagaaaagtgaccttcccagtccagtctatcgtattctcaaattactttctctaacttgtgaaataagatcttcttggtgaactttatcagacatttctgaacagaattaccactctgtggtggcctgggtaaatgtaatatatttataataatttgaaaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgttagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatggcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtttgggagggagactggttaaccagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtatttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaatgtttcacatccaagtgcccatatactaataatttttaactcttttgttggggttaaatgagataaaattgagtcttattgtatagaatttatcagaaatagcaaaatttcgcccaggcacggtggctcacgcctgtaatcccagaactttgggaggccgaggcaggtggatcatctgaggtcaggagttcgagaccagcctggccaacatggtgaaaacccgtctctgctaaaaatacaaaaattagctgggcatggtggcaggcacctgtaatcccagctacttgggaggctgaggcaggagaatcacttgaacctgggaggcgggggttgcagtgagccaagactgtgtcattgcactccagcctgggcgacagagagagattttgtatcaaaaaaaaaaaaaaaaaaggaaaatctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacatgtgtacgtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcactcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtgagccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtatattagttcattctcaagctgctataaggacatgcccaagactgggtaatttataaatgaaaaaggtttgactcacagttctgcagggcgtggaggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggggagagggcacctatctcaaagagaaattttgctctgcttttagatgtacaagggaaagacagagaactgttcctgcatccattgattatcaattgccttcagctcaaaataatccttatgccaaagtagcatattttggggtggcatatttcaacctccttcatctctacccagctggaactgtccagggagttgcatacctcaaaagctgagttggtggctataaagacaagatttgggttagttcctgagaggtaagagacctgcaaagggaaagaacatagatcagaacgagaataaataagcagaaaagagcaaatctcagcacattcccactgatctcactaaaccaggctcctagtactggaaataggtcagtcaacttcaacaattgtatctcatttcaggaagcagcatgcaggtgggagtggggcacccctctgaagtttggcctttatgctatgtgaataatcacacacttaaagagaggcatttctatgaaaacaaaagaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtgactccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaaggaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggggaaatatctcaatgataatgaacattcacaagggtgggttatagttttccattaaaacataaaatttctttctacaatcacccccaatgtgatcaaaaacaatcaaagtatgtctgcttgtgtctggcaactgagtctagtctcattaaacttggccagattatttacataataagtgcagcaagaatagtaatttagcacgtaggcttttttgtgtttgctcttctggaacttttaataaggactctcagaatagacttttaaaagctcttgagagtagtaagccaagccaagaactagccattagactttatctgtaatacctatagattggggtgaatttcccttttcttgaggactctaaaacattctgagtttcccgggcctgccagaaagttaccttccttacccacctgtaaggctaggaacgctataaaccagatacgagtcttacttttccaagggagctttgtaagcgttggtgccatatagtcaaccttagttccttaaaactattgggttatatgtgattccacacacattattttcaaacatgacactgcagtcaaagccttagtaggacagccaatgtttccaattgtgttctgttccaaggagaatagattcttatggaacttaggcaaataactatattgccatgaaaattgaaatactcaataagcatttctgaattttggagagatcaggtaggggcaaaagataaatatttcatttttgtttatgaagacataatctattaaattattgtgaattacaggtagcttttagaaagggtttcctgacatccagaagatagaacattaaataaccagcaaggtttcaatcaaaaaggccataaaaattataattgttttttatcagttcattcagtcccatgtaattaattcttgttttgcttgatcttagattagtggatttatgaatccatcagcttctccattagttctggaaatccttactgtgtccagtgttataatcttgaagttatttaagcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgaaagttcattataagtcaattgataaagaaatttggttgtttctctgacatacaggattttaagataataatgtgataccaagacatctcatgaacagcaagggcattgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctgggaaattccagagtcaattcaaggtcaagaagacttcatttggaatttgatttagggaagttgtgaaaaacgtgaaaaggtttgaacaattgattaaatgggatcacagatcactataaaacaatacttagttatctatttaaccaaagtgacaataaaagattttcaagataaatatggaagataacataatcataaaaaattttaactctttcaatcttaagaaaacttggttttctgaaataatcaaagacataataagtgcaacataaagcacagaatatttattttctaggtgtatcactcaagaggtaaagaaaacatttcataatctcttaccaagaatagactactcggtatagtggctgaggcctgtaattccagtcctttaggaggctaaggtgggaggattgcttgaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcacagctctgtaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtactctttgcctgcagagttttgtttcttcatcctattattactagtagttcatttacacatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagatgggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaataaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatgactcaatctgaataaaatgccatctataagtttaatagccttaaacctcagtagttataatgttagtttgactagtaagtccaagtagaataaaatgtatatttcatgttgacaacttgaagacgtaactctctttaattaaagaaataatattaaactggtagtagcggtgaatccatacgggtatgcagcatccttacatcttgcctccttagaagaaagagttcagctgacggacatacgcagagtgagagaccgaggcaagttttagagcaggaatgaaaggaagtaaagtggaagatggccaagcaggcgacttgagagatcaggtgcaccgtttgaccttctgacttggggttttatacgctggcatgcttctggggtcttgcattccttctcgcctgattctttccttggggtgggctgtccacatgctcagtggcttgccagcacttcaaagggtccgcatgcacagtgtgtttactggacgtgtacgcatgcccacttgaggtattttttcccttagcaaatccagtgttcctagaggaaggtcatccgccattttgccttttagtgccatgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaaccctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagcgtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggtataaatatagaaacacaaaactcacaaatttatatgagctggcatttttgtctttttaaaaaaatctgaattgtatttctggcagatggaacaagaggttacctgctcaatgagggttaaggctttttatcaatattgttggtggagacttaaaaaatttttttcttgacataataatttaatgtagacagtagcattagtctcaggttattgttttagtcaacagaaattaaagccaggtgacttttgggctggaaatcaaagttattaatatttccttaggtgtttacatatcaaagagatggccctcaggtccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttatcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctctaaatatccttttaaacataaaagctttttcaaatcccagttccatcatctggtctttgacaatttaggatctccaaaggtatacgtgctccaaaatgtgacacaaaaccagtaagacttttatgactcaaaaccaatcatccattttatggtttaaccggggaccaagagttgtccccagagagggtgcagaagactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcactaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtgaggcgtggtggctcaagcctataatcccagcactttgggaggctgaggcaggaggatcacttgaggccaggagttggagaccatactgggcaagatagcaagaccctgtctctaaaaaaaatttaaaaattacctggacatggtggtgtacatctgtagtctcagctacatgaaggctgaggcaggatgattgtttgaccctgggagtttgaagttacagtagctatggtcgcaacactgcgctccagcctgggcaagaccttgtctctttaaaaaagaaagaaagaaaaaacaaaacaaaacaaacagagcatgctgttactagatctaagtcaagttctcgggacagaagggaggacttcatcgaatttcttttttattggggacccacaacaacatttgcccaaagggtctgtagtctgctgagaactttaaagtcaccagtctgtgaggctggctcaaacaacaggcttatacacctgtgccaatattctattctatgattttcctccttatgacaaacaacacaaaagacagagacaaagagaaaacaatggctgtctccaggaggaaaaggattaatcacaaaagtcctcaagccaaaaatcacaaaagtcgcaatacccaaagaattatttcttacaaatgttttctcctgccaatctaaatttggagaggaaaagacaaggaaatgctcatactgcactccctcaaccaggctctctgcagaaatcttggggggtatgtggggggatctttttgactgggcatggtggctcacacctgtaatcccagcactttgggaggctgatgcgggaggatcacttgagtccagaagttcgaggctgcaatgagctgtgattgcaccaccgcactctagcctgggcaacagagtgagaccctgcctctaaaaaaaataagataaaaaaagcagtttttcaagggtgtacaatctcctacagcattctatctattctttgattaattaccctcaacccatttagccattaatttattgaacaatgtattagacatccacttcgttccaaagactctactttagggttgaaaaaaacctaggggtgaacctggcatggtttttgccctcaaaattcttaccctatgatgggagagagggaagatatgttcatgattaagctctaagtcagaatggtgaaaaaaatcctttatagaagtacaaagatggagcatgcctcttactaaatagttgtaagagcgagcaagagttactaaagcacttcaggttaaggggaggcagagggtaaggcaggttagtgatagggtacttgtaaaatctccaaagcatgaaaaattttctaatgttttgaagtagcagaatataaagtttgtaggagacaatgtccaaagaagagactgaaatggtagtttgaagccagtctgtgaatccattgaatggaacacttcacagtttagttgcctcttcttgattacagagacttacagaggcatttcaactggaaagtgtttgatctgctttgttcatttgaggaaacaactttgctggctgtgaaaaatgataaacagcatgagggagaatttgctggcaaaaaacaaaacaacaacaaaaaaactaagtttataatgcaacagtcccattaaagagtaacatgaggtgcccttatatacttttagtggcaatgtataacatttggaagtaacttggtagtacttattaatcctttgcaaatctttgcccaaatgagtgacagggtctcactctgttgcccaggctggagtgcagtggcatgaccttggcttactgcaacctccacctcccaggttcaagcaattctcatgcctcagcctcccaagtagctgggattacaggcatgtaattacatgcctggctaatttttgtatttttagtagagatggggtttcaccatgttggccaggcttgtctcaaactcctgacctcaagtgatccacccaccttggtctcccaaagtgttgggattacaggcatgagccaccgtacccagactacaaaaatgtatttatggggatgttcaatgcagtagcagctcatatgtccattcatagaagatgggttaaactctgacgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacataagtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtatttttagtagagacagggtttcactatgttggccaggctggtcttgaatgcctgacctcgtgatccacctgcctcagcctcccaaagttctgggattacaggcgtgagccaccgcgcctggcctaagggctattttttaagttgcaaaacaaaaacaaagttttaacagttgtcattctgatatgtagaattattaggaaacctacactatttattttttatacttgtatatactttgtggttttgttgttgttttggttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctcaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgcgacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattcccaggctcaaatgaacctcccacctgggcctcccaaagtgctgggattacaggtgtgagtcaccacatccggcctgaattgtttctattattcacatataactttgtaatcttaaaaaaaatacttaagactttaaaacaaagatgattagagcctggattaagctagtgtcggcagcctgaggagggaaggttttggatgccattgccaaagtagattgaagaggaattggaatttgagggatgcaggtgattaaaggagagggggaagagtcaaaggtgacactcacatttctagcttggtaaattggttgtttgtttattccattaatagaaatagagaaaagagacagcagaggagggcttcattgaggaggatgactttgttagtttcattttggatttaagtctgagggtcctgaaaaggcagctatatgtttggcttgaacctctccactttccaccttctcagtaattcattaatattttggatgtcctagcctgttgatgtgtgtgtactggaggtggtggtggtgggagctaatatgtttagaagttaacatttcatctgtctttatccttttactctcctttcattcagaccctacaattattgctacagggaagaaatgtggccttgcctgtgaaaatctagtttttggaattttttttgcttgttttccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcatattgcctcgtgtctataatcccagcactttgagaggctgaggcagaaggactgcttgagcacaggaggtcaaggctgcagtgagccatgtttgtgctgctgcactctagcataggtaacatagggagaccctgtttcaaaaaaataaaaaataaaaaaaggaggaaaggaagaaaattccagtagaataaagaaaaaaggaaaaagaacaatatttacaagtacctgcagagagaaggtgagaagatgaagacctgttttctacttttttgggcagcactgctaaagaaataaaaaagtacccagaagtcgcaggactctaataaaatggaacatcacctctattcctgcctgttctttggaggagtagaaggtgaggaaatggggaagtgcaggatgagtgattctggagaagacatggctgtgctcatgttgggctgatgatgtcactgataactaaaacaaagggctcagccaggcacccagaagcctcagggccaccgcaccctaaggaccatgcaggctgagacaggactcttttcagtaatccggaagatggctccaccctctctagtccaggccataccctgggccatacccttagcagtgctacccaaaaaagtaaaaaacaggtcttcgtcttctcaacttctctctccaggttcttataaacattgttctttttccttttttctgtattctgttggaatcttcctttctttctttctttccttttttttttttttttctgaagcagggtctccctatttttttccatgccataccctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaacaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaattttatactgaaagttaaagaagcgacagtagttagattatctcatgcctcctagattggctggctttgagcactttttcaaagtgtgtaccaactagggtttgtccaccaagttgcaatggcttgtatttgagtcagccatacgtgctcatggataaaaacaataagaactctttattaatataaatatactctgtgaaggcaaagatgtgctttaaaggaaatttctgagcatgtgagaagtagatgagttacatgaggttaggagcatgcagctgtgaccctaaatggggagaatacagccccagggagctgtgatgcacggccactgggaagctaatgaaatgggcagagccaggaccagtggggtagaattaaggcagaagcttccctcttgtgctggacattgtgctggtctctttcctgcccagcacatgccaggtaggaggctataatgtgatcatgggtcattccatgccacaggaatggattggcctgagctggccttcttcataatccaggaataaggagaagaaagaggtaggacagaagatggtcctttatgggggatgagggggatggaggggggaagcttctagaggaattggaattttcacagaaagacatttctgcttagatactaatacagacgtacatatttggacaatatacatgtagaataaaaattatttgaattacttcaacaattatgcctacttttcaaaaggctttgacatcagctatataatttagccatttggcaatattaatcataacttactaaactaaatttgacattgggataacagaatggtaaaatgcaaactgaaatcatagctttatgatcacatgaatttccttcaacagctgttcactgttattactacttatacctttgttagcattccaagaggatctgataatcatagctagcattgattgagcaattattatataccagacattcttctaagtgccattatctcatttaccctacataacaaccttatatggtaagtatcttttcctagtgccttttattgatgacatgaatgaggcacagaaaaaataggtaacttgttcaagtccacacagctagttagtggaagagcaggaattgaatccaggcagggtggtttcaatacttcagtcttagacataataccatattgccttcctggtacaatggatgctttacgtaggaggtgttatagggagaaattcccacattttcctttttatacttgtatattgtttgaatttgtttataataaggatacatctcttttgtaacttgaaaaccacaaagaagaaatagaacaataaccccattcctttaaaaatagcattgcagtagctatttcaggtagtgagatatcaaactggttttaacttttttgtttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaagctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagcaagaaaaagggaaaggagtgaaaattcttgcaacatttagctcttccgaaaaaaaaaaaaaagtggtcatgatttctcctatagtagttgatttgtcactttacacaaaaggcctagaaacatatccattatagatatgcctccttggggctcagcctctatctgtcaagtaggggtaatgggtcaatggaattgattatgtgatctataaactttgttccagctttaccatattgtgaattttgaggtttggtcaatgaatatgcaaatccaaccagaagtatcattggatacaaaagtatccgtatcatttttgagaataaaatttccaacagcatttttatatatatcagtgaagatctgtgtcacaaaacaaaactttatgaaataggaaataatctggctgatctttgacagtacaaaatttgacattccaagtcaaattttatgtttaggtagaatagggaagtattggttttgcagttttaccatatcaacacatataatatttctgcatagaaaaacggaccatctaaatgggaaaggggagagccaactagtgggtaaaatgctgtaacagtattttaatgctcaaggcccaattatgacttgaagatgttgttgtactgattagcaatactaactgaaaatttttctaacaggttcataacctaagtattttccagctatatactgttggtctcagggattggcaaagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgtgtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgttttgattatggttgtatggaaaattcttattatatccccaaatataggttacacattttggcaaagtaagcagttattgatttttattgccacatgaactggattttcaaatattaccaaatgcatgtgtttttgtttttgtttttaatacaaaaacatcatctaatggatagtgatttatgccagtatgtaggaaataagcaagtattttgggtcaggtggattactgctgaagctttgattaggcttgaaaatttgatacactggaaagctaactgttaccctatagattactaacaaactcattgcttcaaataaaactgttattgattgttcagattaaaaaaataatgtcgacttttgttttagattcagggggtacatgtgtaggtttgttacacaaatatattgcataatgctgaggtttggggtatgaatggtcccatcacccaggtaatgcaagcaacatgattttattcttttttatgactgtgtagtattccatggtgtatacatatcacattttctttatccaatccactgtttatgggcacataggttgagtccatgtctgctattgtgaatagtgctgcaatgaacacgtaagtgtgtgtgtctttttggtagaatgatttattttcctttggatatatacttagtaatggaattgctgtgttgaatagtagttttaagttctttgagaaatttccaaactgcttttcacagtggctgaactaatttagattcccctcaacagtgtataagcattcccttttctccacagcctcgccagcatctattattttttgacttcttttctgactggtgtgaggtggtatctctttgtggttttgaattgcatttctttgatgattagtgatgttgagaatttttttcatacgtttggtagctgcttgtatgtcttcttttgagaagaagtgtctgttcatgtcctttgcccagtttttttgttttgttttgttttgagacagggtctcgctctgtttcccagaccagagtgcagtggtgtgatcagctcactgcagcctcaaattcctggctgaagcaatcctttcacctcagcccccaaatagctggaactacatatgtgtgccaacacacccagctcattaaaaaaaattgtagaaacaaggacacagtatgttgcctgggctggtctcaaacttctgagctcaatgatcctcccaccttagcctccagaagtgttgggattacaggcataagccactatgctcaggcctttgctcactttttaatggggttatttgttttttgtttattgatttaagttctttatagaatcttgatattagacctttgcccactgcttagtttgcaaatattttctcccattctgtaggttgtctgtgtactctgtcaattgtttcttttcctgtgcagaagctcttcagtgtaattaggtcccacttgtcaattttgtttttgttgcaattgcttttgaggacttagccataaattatttgccaaggccaatgtacagaatggtatttcctgggttttcttctaggattttaaaagactgggatcatatgtttaaatatttaattcatcttaatttttgtatatggtgaaaggcagcagtccaatttttcttctgcatatggctagctaattatcccaataccatttattgaataaggagtcatttccccattgcttatttttgtcgactttgtcaaagatccgatggctgtaggtgtgcagctttatttctgggttctttattctgttccattggtctatgtgtctgtttttgtatcattaccatgctgtttttgtatcattaccatgctgtttttgttactgtagccttatagtatagtttgaagttcagtgatatgatgcctctggctttgttctttttgcttaggattgctttagttattcaggctcccttttggatccatatgaattttagaatagcttttctaattctgtgaaaaatgatgttggtagtttggtaagaacagcattgagtctatagattgctttgggaaatacggccattttaatgatattaattcttccaatccatgaacatggaatgtttttccatttgcttgtgtcatctgtttgtttctttcagcaatgttttatagttctctttgtaggtatcttccatctccttgcttagatttattcctaggaattttaacttttgtgtggctattataaatggcattgcattcttgatttggctctcagcttgctgactgttcagattattgttttataaaagccacaaaaatgttccattagctaaaagtcacgtttcttagttaatagaagtcatagtacataagaaggtaagagtgtcaaattattactagttgtgaatgaattattactagttgtgaaagaatagcaattcatggttttgtttggtcagcaactactgcaccctagtgatgatgaattctctagcagattggaaagatacttagggagggaaaaaagatgactttattaaggatctctggaaataggaaaatatttaagaaattctataagtaaaaatgagtaattttatgtcagaataaaataaaatttggctgaatttatagttctccatctgcctgcttgcacctatttggggcttattttacctttgtggttaccctgagaagcatggtatggctggagcctaagtgagttctttgttttccaaccacattgtcctcttttctttttataaaatacatcaaattccttgcaggtttgtctgtctggagtacttacccaccttctttacttagtaaagtactacttcttttttaggtgtccatttaagttcaaatccttgaagaacttttattttgtaataaagattagattcatatctcctgttaaacactcttatagtattcaggatataccttctaagtggtacatgtggggcggccagcagaagaagattttgtattaggtatcacatttgagaggaaggaggccccgtggaaaaagcttcatcaaaagaaaacaaaagaggtgtttatatgtttctcaaaaggcatgtatctatgtgttggtgaaaactgccttaataagtattacatgtctaatgtgtgtatactaacatgcagctctacgaaatatacaaaaaagttaagcatatagcctatgcttttgaaagcttgagatatatttggggaagtaactatgaagggatgtcccatgtagcctcatatggagcataaaataatgaaatgctatttattatatgtcatgtatgggactggcctgtatggggtcatttgagtgctaagacaagatttctttaatttgcagtactttcccacaatattcatatgagttaatacattatacttaggaaattgcccctaagataattaaattaaaaatatattaccatattaacatgtaaacacaaattggtttaaatgttctctagcaaagatcaaatctaggacagagaaacaggagaagaaaacaggaaaatggggctcagagcaggggaatgctgtgttgtttaaaagccctggatgtcaagatctaaggaaaagataaaaaaaatagaaccaccaccaaatataaatatttatttccatatctcacaattttttcctaggccattgctggtgacagactttccagtccttttcagaacttactcatcacatccttttcatgcttgttattttgatcctgaacatccttgcaattcaaagagcatacagaggcagagtgaaattagcataatgtcacctattgctatgatgctcgttacctctacctccagaacatgccaaggaggcttccaggagccccagaaacacagaacagcaaatcttcaaaagcccagtgcccagagcagatagagaagaaaattctattttgaaatccataaagaatctcataattccttgcaatatctagtcccaattgtgtgggtgacaaactgacctatggcagaattaggaatgtgaataggaatgaggcttggagttccccattcctgctgccctaactcccactggaatgtaatttgtacaaagagtgacgacatgtgaagatgtaaaaaagaggactagagatgtcctcctgagctgcacaaggaagaaagctttttatgaccatccaattctgcaaaggacctagtttcccagtgcttattaccataaggatgcagaaagaaaaaagttcacagacataagatttcatgtgaaaaccaagaaaaaaaggttactgtattttttaaaggaatagcatttgatttggtgtaatggcaggataaagaaatgagaaataacagtggggaaaaaagttgactacaaagatgtgaataagatcagatggcatagtaattttattcgtaattaaaaatctggttcagttaatggagagatttaatttcaggagcattaactagtagactactggatacaatgtacatgtttaaataaatcataaataagtttctcctaagagctactttaatgttgtagcattctaactaatgagtagtatgacaaaattacgttgttattataatagcaatgtatcagtttttctgttgatgaaatttcttagggttagaatttttttttaccagatatgaaatagacttacacttaaatactgttgaaagttgccatataatgtggctattatcttggagttaattaaagttaatttagttttgagcattattaagctctttaagaaaactggaagacatcaaattcttataaaggaaagcaggacctatttgttaaaacaaaaagaaatagctctgtattcaagagtagttttctcaatggatactttgcccgtaaacattaaaactcactaacacttaaaataaatagatttgaatggatggctcttaccacaagttaaaggttgttatttcattaagctaaatgtagtacgtataactgatttttttttttgagggaggaggcattaccttggagaaggaaatggcttcagataacatctatgaaaataataataataataataatgagattatacgcaagatttgaaacattttcagagttggatagaaatttacacaaaccagatttcccctgggagatcctaagataaactaacaataatgtcacacacatatcctgttattttatttactaaattctaaattaaatttctgctctggtgctatgaaggtcacccagcgtactcttttagataatacaggagattccaggattgaaccaaaaccaagctaagcagaatattttccttccgagagatttgaaatttgtgataaacacgtttgattttttgtgtgacattatttggtaaaagtaactttttcagaagctcccccaaatctctatacccttctttgtgccaccgtgttttcttgtgtattggaggtggataagcaaactgcaattgggatagattttcacctaaatttctcacattttcataagtgttctgttcctcttatttactgcttgcaatccacatgtgtatactgcacacacactcacacacatatacacacacataccctcatattctaaagaataaaaacacaggcactgtaattgcatatgtgtatacttagggggttaaagcctggcttcaccactcagtgctggtgtgaacttggagagcttacttagctcaggtccttttgttttcttctgttgtttgtttttgagacagggtctcactctgttgcccaggctagagtgcagtggctcagatttcagctcactgcagcctccaaattccgggcttaagtaatactcccacttctgcctgtagctggtaccacaggcacgtgccaccttgtccagctactttttttttttttttggtagaaacagggtcttgccatgttgcccaggctggtctcgaactcctgggctcaagggatccacccgcctcggcttctcaaagagctgggattacaggcatgagccactgcatccagcctagcccaggttctttacctgtacaatggggataagagtactgatatcacagggtggttgtgaaattaaaatgagatatgtagagatatgtaaagctcttactaaagtgccagcaatataggaaagaacaacaaatgacatttactctttttatgttgtctaaagtcatatgagtatatagtgaagttttcagcataggctctgtgtgagaatacagtagtccccccttctttacagttttgcttttggcagtttcagttatctgcaatcaactgcagtctgaaaatattagataaaaaatcccagaaataaacaatttctaagttttaacttgtgcactattctgagtagagtgaaatctcgcccatcctgttctgtccctctggggacatgaatcctctctttgtccaggggatctatgctgtctacactccccaccctttagtcacttagtaaccatcttgatgatcagattaactgtcacaatgtagcagtgcctgtgtttaagcaacccttcatgtaatcatagccccaaagtacaagagtagtgacatcaacatgttattattattattgttcttttttattattaagtattgttgctaatctcttactgtgactaatttataaactaaacttgatcataggtatgcacgtataggtaaaaaatagtatatatagggtttggtactatccatggtttctggcatccactggggatcttggaacatattccttgtggataacggggaccactgtagaggcaaatggatatagaatatcctttaggtttatttttttgtctgtctttccctaaagcaataaatataaagaaaatctaaatagttggttttgacaacacataggtgtattatattctgcctttttagtgctcagtattccaatatttcattttgtagatgtgaaaattaaggtaatcaagggtggaaatgcttattggagatcatggaactggctcgtgatgcaacagtcatggagtgctggtttaaccgagttgaatacaacacgaatgcccccatgaaaagcaatgaatacagaagtgctcaaaagagtttacctaagaaaataaataggaagaataaaactcaaagacagagaaggtatattaatattcattatcactgaagagaagtaaacttaattttttaatattataagttaatgacctcaagcaaagtcagatattgaaaggtgatcgtttcaaagattgaaactgagtgaaaatatttcaggaaaagagagttttagctattcttaaagaaagagaaaaaagcagattcaaggatagctttttgaagaagatacagcttgaaatggcttcttttactccctcagttaaaagtggtaatggatgtgcctaactaaaattcccacaggaaaaacttctttagttcacctctctcttcctgctttttttagttgatttcctatgtaaatatgagagctcttaataaaaatatgacagaaagttggaaagagttttcctgaaataaataccagatgagtatagtggttacttgaattatgtgcagaaaagaagatgatactctacaagctcggcttttcggcgacaaatctgaagtccatctccattgtgagtatttcttgtgtggcttggacttcctccattccagagaaagaatcagtcctttgggaatccatgaagtgtgtcctactgtgccaggcctcagccactaacacaggtccctagagagccacgctgtcttgctccatgacctccaatgagaaccccttcttactgccctttcattgattaaaacgagacatttgctgggacctcattgtgggctaagcacattgcagtcagtttccacataatgttgctcattggatcattattttaatttttctctctttacctcccccacagctgtctttccttatctgcaatgttgcatgcacaatatttactttcagcaaatgatgtaaatcacccttgaatgaaaagactgaaggtgcctcacctttcttcttcctgtcctattactgtgttctcatggccttggattttctctggataaccacgtatcctagttcatgcttttgtgtcataaggaaaagttggcactcccttttgaaaagctaaacttcccttcctgctattcatcctgacatttctgccctttattaggaacttgattcaacaattttctcttctcttatatcttcaatttctccctttcttgtttctttcctttaggcttaaaaatgtctttaacatccttaggtctttcctattgttaaaaacaagcaaactcagaatccttttctcaaacttaatactttgttgagttggcacccaatttgcctttttttttttttttgagacagggtctggctttgtcacctaggctggactgcagtggtgccatcatagctcactgcagcctcaaactcctgggctcaggtgatcctcccacctagcctgagtagctaggactataggtgcccaccaccacatctggctaatttttgaatttttcatagatatggagtttcaatatgttgtccaggctggtcttgatctcctgtgctaaaacgatcctccaccctcagcctcccaaagaagtgctaggattacaggcatgagtccacgcccagcccttaatttgtctatttttattgttaagtttctcaaagaaatgctcaatgcctgggtcaaggacctctacagatcttgagtctccttaggacatccctttccaactactcatctatttgatgccagattttctacatgtacttcaaccaaaacaacatattgcaacagattgaatgcagaagcagatatgagaatctgctgccttctatgaagcaagacattaaagagatttgcaaaaatgtaaaccagtgctctcttcttttcaaaattatttttattagggaaaatatatttttcataaaaactaggttatttatattactatttaatggagttagcgttgctatttttaaaagagtttatttaaaaagtcttaacttctttagtggtaatttctagtacggtaaacactggtagatttaacccacagaatcagaagctctttgggggtcctcagtaattttaatagtgaaaaggagttttaaaataaaagtagttgacactttatgaggctgaggcaggtggattgcttgaggtcaggagttcaagaccagcctgaccaacatggtgaaaccccgcctctactaaaaacacaaaaattagttgggcatggtggcacgtgcctgtaatcccagctacttgagaggctgaggcaggagaatcacttgaacctaggaggcagaagtgagcgagatcatgccactgcactccagcctgggagacagagtgaggctctgtctctgaataactaactaactaactaactaaataaataaataaaaataggagttgcaaacagtaggtctatatccgtgattgcttttcctcaccactgttgcctcctttttttaaatctctgaccaaagaactggctccacttggtgtcctgtatcagatttcttgggccggccatggtggctcattcctgtaattccagcactttgagaggctgaggcaggaggattgtttgagctcaggagttcaagaccagcccgggcaacatggcgaaactctgtttctataaaaaacacaaaaattagctcagtgtggtggcatgtgcctgtagtcccagatacttgagaggctgaggtgggaggattgcttgagcctagagggtggaggttgcagtatgccagaccttctagatacaagcaagcctcttaccttagcttcctgagtggctgtgatttccctagtcttttatcctccctagttgctaagcaatgtttaacagtgcctacctctcatttcttcttgatattctttccttctacggcaacaaattcccctgatttcttcccaaccttcctgactacccatctttttctctcttggttcctttttcctgggagctgtattttcctcttagctgactcagtatgcttttccttaaagattttttttttctattgcccttccaaaattttttctagatccaaagcctttctcacagtgtcaagaaaaaaacattccagttgccagatgaacagcctgtttcagtatcatgggtctaaaaccagacaccggtttttcctccagcaattcttctggttaacttgatgcctctgtctatcatggaaaccgaatttcctaagtcatgcggatttaaaatgctagaaaatttcttactcctgtcaccactacatctaatgaatcagatgttctgtttgttcttgtgtcatcccagtccactccctgacaaagcatatctgcaagcttatcatcataaacctaggctatttcaatgctcacgtattaaccgctcatcacatgaatagaatttcatttgcctgatttaccctacacagcccttcaaatttatcaacgaaatcactggttttcaacttttatttttaagtaggaaaagcttttccgttaagtttttgcaaacaaatataatgcaatccaatatttgccctccagagctatgccgatttaccgctgaaaccttgagcaaagaaatactcaaagcttcttctaggttgtgtatgtatcacaacagaggaaggaaattatgagatgggcacttgggagactgttttcttggttgccctctccttgtgaaaggtagggctacaagcccccatttgagccaaagctaaggagtccggtgcccatgaaaaagacgcaagcaatgctgtcctccttgatggaggctgcagaggccagaaccacacctgctcagcctggccctgaggctgcccctgtggcactgctgaaagtcagtcttttgtcacaaggaaggcagtttttctagacaagattattctcatcttaagcatgaggtaggggtgtgtgtgtgtgtgtgtgtgtgtgtgtgtgtgtgtgtagtgtctaagtctacttgcctgctttctgggaactggtaagagataggaagatagaagtcatcatcattccaaatgtaggctttcacttaatttctctattttcagtctgagaccacacatttacacgtctctcagcctgcatccccaagctcaaaatatttctgctttaatctcttcagagactaaacctcctgtcccccactacatggagaaggcttggttacctgttattcaaggtgttgcctggatctgtgtatatactttaattcattccctctgttttcagcaccaacacccgccccctttcctcctagcttccttggtacttggtgcctccaatttttgaggctttctataattacttagcacaaatcaactttcttgttgattttcttctttataggagcatagatttcagcatttgtgactttgacaagtcagttgttacaaattcatcagctgcccatctgataaaattttaatgtcttttctactctatctcttctagcttttcttttcttgtgtgtcgatacccattttatttctttacttaccctcattttagtggcatttcaaaaggcgtactagttacctattgctatataacaaattaccataaacttagttgcttaaaacaatgcacatttattctcttagagtttctgtgggccaaggtactgggtgtagctcagcttggccccctactttagagtctctcacaaggctgcagtgaggtgctggccaagactgggatctcatgggaaggctcaaaaggaaaagcatctgcttgtatgctcctggagttacaggcaggttttagttcctgatgagctgatgaactgacagtcttgttctttagtgactctgggccagaggtcaccctcatcccttgccacatggctctctctctatagcagtttgtttaatcaaagctagcaatggtgagaatctgccaacaaaatagaagtcactattttgtgtgacataatcacagaaatgacatctcatcatgtttgccacattctattggctaaaagcaagtcaccaggcccgcccatactcaaagtgaggagattatacaaggcgtaaataccaagaggcagattagaggctattttagtctgttgatataggaggccaaggtgataaacacatgggtccaagtctctctctaaaactggagtcccctctctctcacttccatcaagcttacagtccacttctcctgtcaaggtcaagtagtgacctccatcttgcacaatccagtgaactatcccaagtgatcatcatactcaaacaaacaaccagtagcaactgacatattctcttcctgaggcattttatttctttggatttggggatccctcacctccttgtcttttcccttcatctcttgtctctgactcacaggctcctttgttcattctcatttttcttccttttggagggctaaatgctagaggtctacagggctccatttgtagcccttcactcttctgtaattgtacctaagaaatctagtctcatgacttcatagtccatgtatatattgatgactcttacatttatatctccagctccaacctttcccctatgccccagatagtacccaattggcatctgtacttggactcaaagacattgcaaacttaatttctcaaagaattaaaaatagaactaccattcgatccagcaatcccactacttggcatctactcaaaggaaaagaaatcattatatcaaaaagatacccccacttatatgtttattgcagcactactcacaaagggcaaaaacatggaatcaacctaagtgtccatcaatggattggataaagaaaacgtaatatatatacatacacatacaacacacacagacacacaccgtggaatactactaagccataaaaaataaaatcatgtcttttgcagcaacatggatggaactggaggccattatcttaagtgagataacccagaaacagaaagtcaaatattacatgttctctacttataagtgggagctaaatatgtgtaccatggatatagaaattggaataatagacattggagactcataaagttgggagggtgggaagggttcaagggatgagaaattacttaatgggtcaatatacactaaaagctcagatttcatcgctattcagtatatcagtataacaacaaaactgcacttgtaccttctaaatctatacaaataaaagctaaaaaatgaaaacaaattagacatctcaaatgacaacttaatgcagaactcttgatttcctcatccttccctgacctttacctaaaaacacactctgcccaaactgatgcccatttcaataaatgtcactaccttccacccagttgcttaggtggaaatccaggcattttctttgttcctcttctttttttcacaccccacatacacttctcactcagcatatcctgacagcgccaccttcagaatatgtccattatccaaccgcttctccccagttctcctgcaatcacccaggcgtggtcatggttgtctcttgcctccccttgactggtacatgtgccgttcccctttgcatcaagcttacatctgctccaggatgtttatatttgcagttctctccacctgtaattcttatccttctgatttgcatgtaactcactcctttttatcatccaggtctctccttaaataccacctctttggaaagccttccttgatcactctgtgtaaaatagccaagcctccgttattcactatcttcttttgctcttttatttttcatatatgactacgtgaaagtactgtctgttgttatatgtctagttacttgttatgtgagtataagcttaatcaaggtgatgctttattgcacttagcgctgtttccctgcaatccagtacaaagcccagtatgcaagttataggcatgtggtaagtgttggatatgtgcaccagttgttggacaggattgaacttgcgaggtcagctttctcaggtgacctcaaaggcaagcatctagtttattgagtagtacaacaataggtatgttgcatgtacatatatgtataacagaagtttatttttaagcctgaattagtgatagcaactctgttcatgagtgattatgtggttctttttcatctttactctttctcagagaaattcttctcttcttcccacattgtttgactgcttagagtagataatagaggagtggtaagatgtctgagtatataatgtaagggggtttggttcttgtcatatatagaatacatataggtcctattataaacaacatatggttcttctcatatatagaatacatacaggtcctattaaaaacaacatattgtagctttaattcaacacacgactggttcttgtataaagtttcactgagatctttattgtggagaattgcatgactattccagtcctggactcaatttgaataaaaacataggaaccaaattcctccactaaataactgattgatacttaaatttgacaacgatagctttatagaatagtccagaacatatacagtcgtacctcacttaacaatgtggctacgttctgagaaatgtgtcattaggcaattcccgtcattgtgtgaacatcatagggtatatttacacaaacctagatggtatagttcactacacacctaggctatgtggtacagcctattgctccttgactgcaaatccatacagcctgctactatactgaacactgtaggcaattgtaacacaaaggtatttatgcatctaaacatatctaaacatagaaaaggtacagaaaaatgcagtatagaaaataaaatatggtacacctatgtagagcacttctcacgaatggagcttgcaggactggaagttgctctgggtgtcagtgagtgagtggtaagtgaccgtgaaggcccaggacattactgtatacggctatagactttataaacattcttcacataggctgcactaaatatgtattaacaatttttctttcttccaaaattaacctaattactatatcttttcactttataaacttgtattttttaaaccttttgacttttgttatacttactttaaaacacagacacattgtacagctgtgcaaaaatattctttcttcatattcttattctataagctttttctgttttaaagttattattaattattattattttactttttaaacatttttgttaaaagcacacattaaacacacacacacattatcctaggcctacacaggatcaggataatcaatatcactgtcctccacctccacatcatgtcccattggaaaaagtccagggacagtaacacacacggagctgtcactttctgtgataacaatactttcttctggatacctcctgaaggaactgcctgaggctgttttacagttaactttttttcagataagtagaaggagtgcacttaaaagaacaataaaaaggatagtaaatacatagaccagtaacatagtcatttagtgtcattatcaagtattatgtactgtgcataattgcacggactagccctttataccactggcaggacagtaggtttgtttacaccagcaacaccacaaacacgagtaatgtgttgtgctacaatgtcactaggtgataggaattttttagctccattataatccttttttttttcttttttttgaggcggagtctcactctgtcgcccaggctggagtgcagtggtgctatctcggctcactgcaaggtccgcctcccgggttcatgccattctcctgcctcagcctcccgagtagctgggactacaggtgcccgccaccacgcccggctaattttttgtattatttgtagagacggggtttcaccgtgttagccaggatggtctcgatctcctgaccttgtgatccgcccgcctcggcctcccaaagtgctgggattacaggcgtgagccaccgcgcccagccagctccattataatcttatgggaccactgtcatatatgtggtccacggtttagagtatggaaatgactctatttccatacagtacttccaataataaattaagttgtttgatttctagattgaaaatggctttgataatcttgtaattggatttatatgcctttgagtctctcaagtagaactgatttacctttccattcctttctctttcctctctggtcacatccctattccacatttgttttttttgtaaccagatacacaaataatactttgtattaagtggttatagtgaaagctgggcattctgttctagtgaataatgattcttatattccaaggacaaactacctattaataataattgggtattcggggcttaaaagttgtatttgaaagatgcagccaggtgtggtggctcacgcctgtaatcctagcactttgtaaggctgaggcaggcagataatctgaggtcaggagttcaagaccagcctgaccaacatggtgacacctcatctctattaaaaaagaaaatacaaaaattagccagacatggtgggaagcacctgtaattccagctacttgggaggctaaggcaggagaattgcttgaacctgggaggcagaggttgcagtgagcagagactataccactgcactccagcatgggtggcagaatgagactccatcagaaagaaagaaaggaaagaaagaaagagagacagagagagaaggagagaaggagagaaaagagagaaaagaaagaaagagatgttatccatgatttagtggaaatgagaaaacctagaaaataccatgcaattctaatgaaaattctagaaaactagaaaaaaggaaagagaaggaaattgagaagaccctgtaatctgttgaaatgctgagttttcctaattaaggaaagtaaaattctagtcacttaaaatgcctccaagaaagtcactgtttttgtccatttatatctttctgctttctttttcattttttccctaaaaattaattaaatattaattacttttagaggaaagattactctgataaaatggtcaagaaaagcaaagtttcttactttctgtgccaaagattttcagccaaagtaataaaagaaaaatcttaaaaagggaaactatgcaattcgaatggaagatccattttaaaaagttattgtggcagtataaaatgatactgtgtgctcaaatacctaaaaacttttgcaacttacgaaatggtatttttagtattacttagggtgttgtatgggtgtcttatgtaacttgttaaggtaaagaattttgctattctcaacttcagtttatgcatctataaaatgagaaagcgcaaaataatacttctacctcatagggttatcgtgaaagttaaatgacagagggataaatgaaatatttagtatagtgcctaccacaaaagccaaagctaaataagtgatagccaagaacaaacacagaaaacttcctaaataaaaatatgactagaataactgcaatgtatggaccaacataagcatgtttaagagtgaacacaggtgctattagtaattacacctggaccaaaagtataacccaggatgctccctgacatactagaatttatggtttctctatctataatctattaacatagcaggcagtaaaccttctcttttgtggagaccacacatgcaccagacaagcagagcctggattcaatagtgtgccagtaactcacccagattttcaagaagtaatatttactgggattatggattaatcagagcttgtgtttaccaaagtaaagttcaccaatgattcttcaaatatgttcacaagctaacttggcttatatccatttacttataaatcagaagattccccaagattttactgtctgcctgattaaagctagtatgtgctataagtgttttcaaaatacttttttccaaaactgtccttgcagttaaggtgctgttaattcaaagtacctatgacttcctatcagaaatgaaaatgacacttaatgagaacaaaacatgttttcacttgaaatgcaattaaaccaaattagagaaacagtgtttttctaactaagataaaaacagctgtgtttatgaagctgctctaatggtattagaatttctcttatggaaacttttgctttatttaagatatatgatttttattttaattgacattttagacaatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaaaaaaaagaatgcttccatttctacacttaacatttttttctttatctttcataattacggtccataacacttggagtaacaacatgttttcctgtgtatatataatataaatggttatatacaaacaatagaagaaatacgcaatttcccaaaatgataacatttgaagacgtcattaccaacaacaacatcactagaaacattactgctgttaagagcttgatctagaaaatataagcttaaactgctctgtttggaaacagcatgtaatcgggatatttaactagaaattcaagtacaataaaatggatttaattagttatgtagctataaaataccttaaatttttttaggctatgtctgcatgggcaactacttaaatgtttttagattaatttattttagtcaatttaattttaataattacctcaactatatgttattttcttcctttaaataatcacagaacacgctgttttaggatcaggtagaagctgagacaatctcttttgaacaaattttatttttattccaaaattaattgtcctaaaaatagtacatttagccatgaaaaagagaaaacaagtaaacctatcaaaatgggacactgttaattaactaaacatagaaaatagattcattcattatccaccaaaaatttcaatgtacctgccaggtaaaagcaccatattcagtaccatgaaagtgataacgattccaataacagaacatcttccctcaaagaacttatcacatgtttatgtataagtttaaatgcattgaatgtcaaaaatgcagatagcgctttgatcaaggacattttagcaatgtattcagacaggatctttattttctagggttttcattataaggcagaaaggttagactaaagagtaatgttaaaaatacaaattatttttgtattctagacatttctataagaaatgtatggaaatagaactgtaattttggcagtttttgtcacagtgtcagtgagcaaatagatgtcatactcatgagtacagaaagaggacattctctttaacagccacatacttcttacccagaaacccttggagaagatttataaacccacatactcagaatatggtaatgaggaaatgctgtctgccctgggaaggggaagaggatctaaaacatttaggacaggtaattccacaaccatgccttaagataaatccatgccttgaaaagtaaaaagaacagcaaaaacagctagttagtcaaaggtcaagatagcaaaccctagctggtaaacttgtctgaatctttactgtattcctcaagctataaactatgtttatagactccttcaaacaggattaaattttggaggcattttcttaaaaaaatagtaaatccccactgtaaaattagttataggctttggacaggattcttgccaatggggctcagaggcttaagttttattaatttcacagtaactccaccttagttcacagatattttcaaaacatggaaagtgtgattgaagtcaggtaagtctaatcaaatatgagttctggtgccacagaacggtgatgttgaaatacttggcttttattggctatttatggcttttattggcatattaatgtcttttactgatgatctcaagttctgtctatagaaacactgatgtctgattgtaacagtttaatcaatgtataaaccaatctggatggttcagatctcaattccaacgtttcctttagaattcaggctcaatttatctaaattgggctcattatattattattaattttactttggctgtgggctgagttaaagcacactatgtttttgagcattctaagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttctaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatggacctccttaggaacatgtacatatttccctaatgaatccttaggctgtgatatgttttcgagttaaattgttattactgatagaaaagttctttatgtctgccataaatgtgcattaaagtttatatagcattcaccttcatgattggtgttttatcttactgattattttggcagagaacaaataccaaaagtctccccatgagaaataaaaacaaaccacgaccctctaaaaatagaaaaaaagccacaactcttcaggtcctccttggacccatggacaaggctcataaacctccttggtgtccattccatgttctgtgaatctggctgatggtcaaagaaagggctagagacaggatgatctacaaatagaggagattgaatttccaaatgaggtttgatcatctgctctttgtgaattttttccaattgcttccccatgtgccttggtttagcctttcaaaaaattagaattttatacccctaggatgtaaaataccatgtcagcgcactttttgtgcctggaatgcaccttggagatagccttgcccattgaccagctcttcatttttcagagggagaagaaagtgaggtctgggaaagtaaaatgcctgcccaaatccacagagctaagaagtagcagagcagagatcattaccacacattccaaactttcttcctatttatcatttttctccttgagccccttcttgtctgagacactacatcaattaaaattattttataactgcaacatcgtacaattgccatgtaacacattgcccaatgcaattcaatcttagcatctggaaacaatactcatttattaactcacactttgtaggtcagaagtctgagcacagcatagcaaagtcctgttcttagggtctcaccaggctgaaatcaaggtgttgaccgggccgtctcctaatctggagtgtggagtcctcttccaagtccattcaggttgttggcaggattaattcgttgtagctgtaggactgaagtctcttttcttgctagctgtcagccaggggcagctccaagctctcagacgctgccctcaggtcttagatgtgtggccctctcactatacgacagctacttcttcaaagccaataggagaatatttctcttcaggaaaggttcactccctttttaaggactctgctgatgaggtcagacccactcaagacaatctccctcttgattagctcaaagccaaccgactaacaactagtcaagagtggtatcccatcatagtcgtaattctcacttgtgctcaaaggggaggggatcatacagcatgtgtgtaccaggggacaggagtcttgggagtcatcttagaattctgtttgttgggccgagcgcggtggctcatgcctgtaatcccagcactttgggaggccgaggcaggtggatcacgagatcagaagatcgagaccatcctggctaacacggtgaaaccccttctctactaaaaaaatacaaaaaattagccgggtgtggtggtgggtgcctgtagtcccagctactcgggaggctgaggcagaagaatggtgtgaacccgggaggcggagcttgcagtgagcggagatgcgccactgccctccagcctgggcgatggagcaagactccgtctcaaaaaaaaaaaaaaaaaaaaaaaaaaattctgtttgtcggccaggtgcagtggctcacgcctgtaatcccaccattttgggagaccagcctggccaacatggtgaaatcccatctctactaaaaatacaaaaattggccgggtgtagtggcgcatgccagctactcgggaggctgaggcaggaaaattgcttgaacctgggaggtggaggttgcagtgatcccagatcgcgccactgcattccatcctcagtggcacagtgagactccatctcaaaaaaaaaaaaaaaaaaaaaaaaagaattctgtttgtcacgttggtctgattctactcattcaagtactagatttccttttgcctcctcttaccttctgctgccccccaactgagttggttcattgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcaccaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtcagaagtgctttgcctaataaactcaacatgcatgttgatgctaagagtctaactgaacacacaggacaatcgcaaatctgtgaattattaagcctcctttcacctcaatttcctccctcataggatggtctttgcttatctcagttttgtgtgtattccttttgattgcttgttaatgtctcctatttatagtgatattatgtaacagtattatttaatctccaaaatagtatacaattgtcaagtaccattgctgtaattatggtgcagatgttggaatatgcttggaatcactaaaagtgaatttaccataagctaaggaagcttactcttcagggactctgacttgcaagagcctatttaatttcttattacctaaatttgtaagtttaattttgcagtatttttcttttaaaagatcccccaaattttatgagcttcatttccagaaaactcatctggccttgtttttcatattgtattgtcatatttaatttgtttttatgcctttctcacaatattttaggttcatgagatcagagacagtattttatttgtttctctactgcctagcttattatttatttatttatttatttatttatttatttatttatttattgttatgagacagggtctcactgtcacccaggctggagtgcagtggcacatttatggcttactgcagcctcaacctcccagggctcaggtgatcctcccacctcaacctcccagtagctgggactacaggggagcaccactacacctggctaatttttgtatcttttttttttttttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattttgccaaaaatgcaatttgtcttgttagtcttctttaatttttccatgttttaaaacttttcttggagtatttcccaaatgggatttactgagaggatatattcagccagctttgtagattctaagagtccttctaaaagttaagtctagccaaggaaaaatgtagtggcacacgattgcgtttctcttacgctgtcatttaatgtgagatctaaattttgcatttctttaatgcccaaggtgtttattttttaaaatctgtactctttttatcaggagttatgttgacaatttacctgggagctgatataccctatataatacatgatctaagacctgaacaatacacaaattaataaaattaaaccattaagatatgtcatcatttctaaattatacaattgggttttttttttaaagcaaaaatattcttcctcttttctccatcccttgttctggtcagttccaaggttttttacaaatgcaaaagaaattcatttgctactcctgaccacagagatgaataatttaaggacaatatcaaattcttgataaatctcataaatgttttaactgtccaagaaatggacatttatttggttaatcttttagctggccataaataatgtaataaaaccccttaaaattaacattaaataacataaagacctaacgatttttagaaaaaaacctttttggactgagccttgaatttcctgagaattcagctacaagtgataactaaaatgtaactcgagaatctggatatggttccagaaaggattgttgtcatgcaattgccatttcatcatctttccttaaagtcccttcaatatttatcattgcaatttttgtcctgtcttttcccctccatcacatcaaaccaaggaaaaacaattattaaatgctcatttatactcacctccctcccttcatattcattcattcctcagccctaaaattcctgtaggaatcctgcttttacgttttatcttaaagccaccatagtatctgtaatctcttttgtagtcatgtatgcttaattttggaagactgtcaactacctcttcaggttcattcaaatgaaaatgtatcacaaaatcgtaggctcttcccctatctcactgaaaaattactctaaaaatgaccagtaagctgttttgttgaagcaaaacatccagaccctaaacaaaagtagcagaattacaacatttccatagaaatggattttgagcttcttttttttaattggggaaaatcttattttttaaaaaagaatcccagaatacatctttgctttcagtccttcaattctaacataatgccatgttagagaatatgtggtagtgtatactaagcccttatgctgtctcacatccttgggacaaaatatctgttttgaaaggacttctctgaattttgctatttcctgcttactgagcagtggccccctcctgggaaaacagagttatttcagccagtgttcagactccatcttgcatacgtctctgtggaatattaatagtgctactgagatatattcatcatcttttctctgcttttgctgtctttatagcccagtgaaatttatatttggtgtttgtaggaaggctatcagaagctacttggacatcaaacttttaaactataaataatgatggcaagactgctaggatatctttccacagttaaacccattcaacagagtttcgttcttatgacagtgcaaattaaactagaataaaattagtgtgattttaggacagttttaaagtgaacatatttccctccctcccttcccatctacatatcaaggagacactccagactgcacttttatttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa
